US009655964B2

(12) United States Patent
Perez et al.

(10) Patent No.: US 9,655,964 B2
(45) Date of Patent: *May 23, 2017

(54) BISPECIFIC ANTIBODIES DIRECTED AGAINST TNF-α AND IL-17

(71) Applicant: AbbVie Inc., North Chicago, MA (US)

(72) Inventors: Jennifer Perez, Worcester, MA (US); Suju Zhong, Shrewsbury, MA (US); Lucia Eaton, Grafton, MA (US); Anca Clabbers, Rutland, MA (US); Chung-Ming Hsieh, Newton, MA (US); Lorenzo Benatuil, Northborough, MA (US); Yuliya Kutskova, Northborough, MA (US); John E. Memmott, Framingham, MA (US); Margaret Hugunin, North Grafton, MA (US); Alyssa Brito, Hudson, MA (US)

(73) Assignee: AbbVie Inc., North Chicago, IL (US)

( * ) Notice: Subject to any disclaimer, the term of this patent is extended or adjusted under 35 U.S.C. 154(b) by 482 days.

This patent is subject to a terminal disclaimer.

(21) Appl. No.: 13/659,666

(22) Filed: Oct. 24, 2012

(65) Prior Publication Data
US 2014/0161804 A1 Jun. 12, 2014

Related U.S. Application Data

(60) Provisional application No. 61/550,619, filed on Oct. 24, 2011.

(51) Int. Cl.
*A61K 39/395* (2006.01)
*C07K 16/24* (2006.01)
*C07K 16/46* (2006.01)
*A61K 45/06* (2006.01)
*G01N 33/53* (2006.01)
*A61K 39/00* (2006.01)

(52) U.S. Cl.
CPC .......... *A61K 39/3955* (2013.01); *A61K 45/06* (2013.01); *C07K 16/241* (2013.01); *C07K 16/244* (2013.01); *C07K 16/468* (2013.01); *G01N 33/5308* (2013.01); *A61K 2039/505* (2013.01); *C07K 2317/21* (2013.01); *C07K 2317/24* (2013.01); *C07K 2317/31* (2013.01); *C07K 2317/33* (2013.01); *C07K 2317/565* (2013.01); *C07K 2317/567* (2013.01); *C07K 2317/622* (2013.01); *C07K 2317/64* (2013.01); *C07K 2317/76* (2013.01); *C07K 2317/92* (2013.01); *C07K 2317/94* (2013.01)

(58) Field of Classification Search
None
See application file for complete search history.

(56) References Cited

U.S. PATENT DOCUMENTS

| 5,624,821 | A | 4/1997 | Winter et al. |
| 5,648,260 | A | 7/1997 | Winter et al. |
| 6,309,636 | B1* | 10/2001 | do Couto et al. ......... 424/133.1 |
| 7,612,181 | B2 | 11/2009 | Wu et al. |
| 8,735,546 | B2* | 5/2014 | Ghayur ................ C07K 16/244 435/252.3 |
| 8,779,101 | B2 | 7/2014 | Hsieh et al. |
| 2006/0024308 | A1 | 2/2006 | Crea |
| 2009/0239259 | A1 | 9/2009 | Hsieh |
| 2009/0311253 | A1 | 12/2009 | Ghayur |
| 2010/0266531 | A1* | 10/2010 | Hsieh .................. C07K 16/241 424/85.2 |
| 2011/0212094 | A1 | 9/2011 | Ghayur |
| 2011/0250130 | A1 | 10/2011 | Benatuil et al. |
| 2012/0034160 | A1 | 2/2012 | Ghayur et al. |
| 2012/0230911 | A1 | 9/2012 | Hsieh et al. |
| 2013/0164256 | A1 | 6/2013 | Hsieh et al. |
| 2013/0171096 | A1 | 7/2013 | Hsieh et al. |
| 2014/0170152 | A1 | 6/2014 | Hsieh et al. |
| 2014/0234208 | A1 | 8/2014 | Ghayur et al. |
| 2014/0335564 | A1 | 11/2014 | Hsieh et al. |
| 2014/0343267 | A1 | 11/2014 | Hsieh et al. |
| 2014/0348834 | A1 | 11/2014 | Hsieh et al. |
| 2014/0348856 | A1 | 11/2014 | Hsieh et al. |
| 2014/0356909 | A1 | 12/2014 | Hsieh et al. |

FOREIGN PATENT DOCUMENTS

| WO | 9729131 A1 | 8/1997 |
| WO | 2004050683 A2 | 6/2004 |
| WO | 2005014650 A1 | 2/2005 |
| WO | 2006119107 A2 | 11/2006 |
| WO | 2008061013 A2 | 5/2008 |
| WO | 2008115732 A2 | 9/2008 |
| WO | 2008133722 A2 | 11/2008 |
| WO | 2009047356 A1 | 4/2009 |
| WO | 2009091912 A2 | 7/2009 |
| WO | 2009149189 A2 | 12/2009 |
| WO | 2010102251 A2 | 9/2010 |
| WO | 2011059755 A2 | 5/2011 |
| WO | 2011127141 A1 | 10/2011 |
| WO | 2012018790 A2 | 2/2012 |

OTHER PUBLICATIONS

MacCallum et al. Antibody-antigen Interactions: Contact Analysis and Binding Site Topography. J. Mol. Biol., 1996, 262:732-745.*
Padlan et al. Structure of an antibody-antigen complex: Crystal structure of the HyHEL-10 Fab-lysozyme complex. Proc. Natl. Acad. Sci. USA, 1989, 86 : 5938-5942.*
International Search Report and Written Opinion in related application PCT/US2012/061690 mailed Mar. 15, 2013, 20 pages.
International Search Report and Written Opinion in related application PCT/US2012/061666 mailed Mar. 15, 2013, 22 pages.

(Continued)

*Primary Examiner* — Dong Jiang
(74) *Attorney, Agent, or Firm* — Sterne, Kessler, Goldstein & Fox P.L.L.C.

(57) ABSTRACT

Engineered multivalent and multispecific binding proteins, methods of making, and specifically to their uses in the prevention, diagnosis, and/or treatment of disease are provided.

35 Claims, 1 Drawing Sheet

(56) References Cited

OTHER PUBLICATIONS

Lewiecki, Michael: "Sclerostin monoclonal antibody therapy with AMG 785: a potential treatment for osteoporosis", Expert Opinion on Biological Therapy, Informa Healthcare, UK, vol. 11, No. 1, pp. 117-127 (2011).
Nakanishi, et al., Interleukin-18 regulates Both Th1 and Th2 Responses, Ann. Rev. Immunol. 19: 423-74, (2001).
Arndt and Krauss, Bispecific Diabodies for Cancer Therapy, Methods Mol. Biol. 207: 305-21, (2003).
Durocher et al., "High-level and high-throughput recombinant protein production by transient transfection of suspension-growing human 293-EBNA1 cells", Nucleic Acids Res. 30(2), (2002).
Mizushima and Nagata, "pEF-BOS, a powerful mammalian expression vector", Nucleic Acids Res. 18(17), (1990).
Holliger et al., Diabodies: Small bivalent and bispecific antibody fragments, Proc. Natl. Acad. Sci. USA 90:6444-6448; (1993).
Poljak, et al., Production and structure of diabodies, Structure 2:1121-1123, (1994).
Urlaub and Chasin, "Isolation of Chinese hamster cell mutants deficient in dihydrofolate reductase activity," Proc. Natl. Acad. Sci. USA 77:4216-4220, (1980).
Kaufman and Sharp, Amplfication and Expression of Sequences Cotransfected with a Modular Dihydrofolate Reductase Complementary DNA Gene, Mol. Biol. 159:601-621, (1982).
McDonnell, et al., TNF Antagonism, Progress Respir. Res., 31:247-250, (2001).
Harriman G, et al., Summary of clinical trials in rheumatoid arthritis using infliximab, an anti-TNFalpha treatment, Ann. Rheum. Dis., 58 Suppl 1:I61-4, (1999).
Peng, Experimental Use of Murine Lupus Models, Methods Mol. Med., 102:227-72, (2004).
Bossers, et al., Analysis of Gene Expression in Parkinson's Disease: Possible Involvement of Neurotrophic Support and Axon Guidance in Dopaminergic Cell Death, Brain Pathol., 19: 91-107, (2009).
McGee et al., "The Nogo-66 receptor: focusing myelin inhibition of axon regeneration", Trends Neurosci., 26:193, (2003).
International Search Report and Written Opinion in related PCT application PCT/US2012/061686, mailed on Mar. 15, 2013, 24 pages.
Barbas III, C.F., et al., "In vitro evolution of a neutralizing human antibody to human immunodeficiency virus type 1 to enhance affinity and broaden strain cross-reactivity," *Proc. Natl. Acad. Sci. USA* 91:3809-3813, National Academy of Sciences, United States (1994).

\* cited by examiner

A
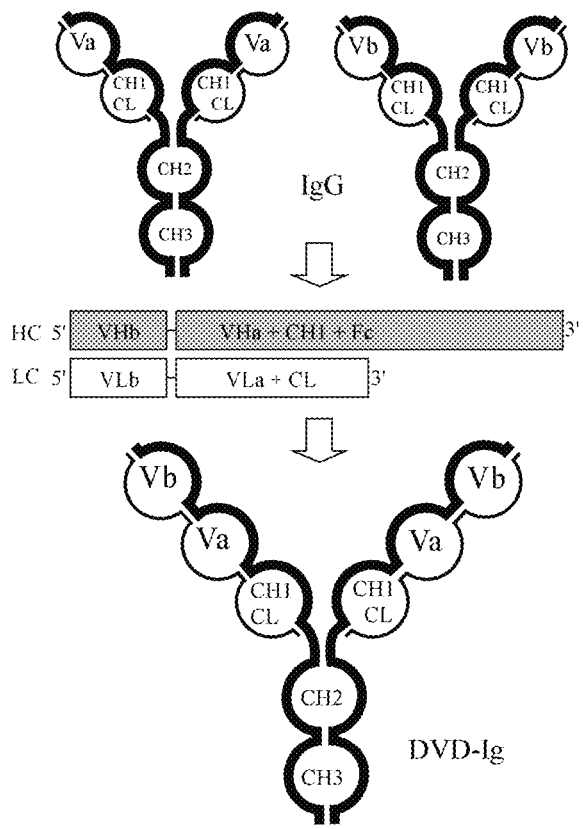
B
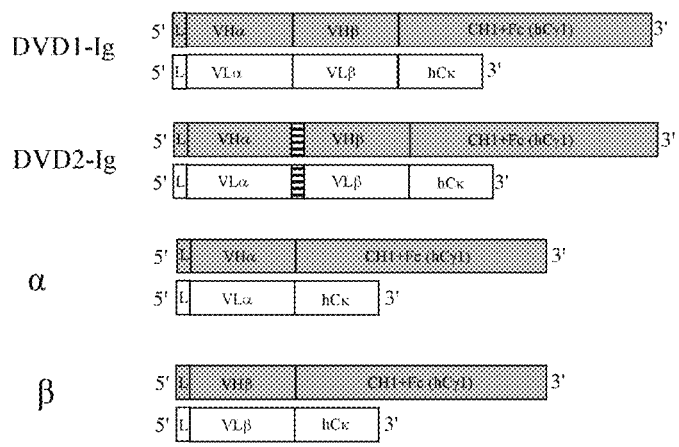

BISPECIFIC ANTIBODIES DIRECTED AGAINST TNF-α AND IL-17

CROSS-REFERENCE TO RELATED APPLICATIONS

This application claims priority to U.S. Provisional Application Ser. No. 61/550,619, filed Oct. 24, 2011, which is incorporated herein by reference in its entirety.

BACKGROUND OF THE INVENTION

Field of the Invention

Multivalent and multispecific binding proteins that bind TNF and IL-17, methods of making, and specifically to their uses in the, diagnosis, prevention and/or treatment of acute and chronic inflammatory diseases, cancer, and other diseases are provided.

Background of the Invention

Engineered proteins, such as multispecific binding proteins capable of binding two or more antigens are known in the art. Such multispecific binding proteins can be generated using cell fusion, chemical conjugation, or recombinant DNA techniques.

Bispecific binding protein have been produced using quadroma technology (see Milstein and Cuello (1983) Nature 305(5934):537-40) based on the somatic fusion of two different hybridoma cell lines expressing murine monoclonal antibodies (mAbs) with the desired specificities of the bispecific antibody. Because of the random pairing of two different immunoglobulin (Ig) heavy and light chains within the resulting hybrid-hybridoma (or quadroma) cell line, up to ten different Ig species are generated, of which only one is a functional bispecific antibody. The presence of mispaired by-products, and significantly reduced production yields, means sophisticated purification procedures are required.

Bispecific binding protein can also be produced by chemical conjugation of two different mAbs (see Staerz et al. (1985) Nature 314(6012): 628-31). This approach does not yield homogeneous preparation. Other approaches have used chemical conjugation of two different mAbs or smaller antibody fragments (see Brennan et al. (1985) Science 229(4708): 81-3).

Another method used to produce bispecific binding protein is the coupling of two parental antibodies with a hetero-bifunctional crosslinker, but the resulting bispecific antibodies suffer from significant molecular heterogeneity because reaction of the crosslinker with the parental antibodies is not site-directed. To obtain more homogeneous preparations of bispecific antibodies two different Fab fragments have been chemically crosslinked at their hinge cysteine residues in a site-directed manner (see Glennie et al. (1987) J. Immunol. 139(7): 2367-75). But this method results in Fab'2 fragments, not full a IgG molecule.

A wide variety of other recombinant bispecific antibody formats have been developed (see Kriangkum et al. (2001) Biomol. Engin. 18(2): 31-40). Tandem single-chain Fv molecules and diabodies, and various derivatives thereof, are the most widely used. Routinely, construction of these molecules starts from two single-chain Fv (scFv) fragments that recognize different antigens (see Economides et al. (2003) Nat. Med. 9(1): 47-52). Tandem scFv molecules (taFv) represent a straightforward format by simply connecting the two scFv molecules with an additional peptide linker. The two scFv fragments present in these tandem scFv molecules form separate folding entities. Various linkers can be used to connect the two scFv fragments and linkers with a length of up to 63 residues (see Nakanishi et al. (2001) Ann. Rev. Immunol. 19: 423-74). Although the parental scFv fragments can normally be expressed in soluble form in bacteria, it is, however, often observed that tandem scFv molecules form insoluble aggregates in bacteria. Thus, refolding protocols or the use of mammalian expression systems are routinely applied to produce soluble tandem scFv molecules. In vivo expression by transgenic rabbits and cattle of a tandem scFv directed against CD28 and a melanoma-associated proteoglycan was reported by Gracie et al. (1999) J. Clin. Invest. 104(10): 1393-401. In this construct, the two scFv molecules were connected by a CH1 linker and serum concentrations of up to 100 mg/L of the bispecific antibody were obtained. Various strategies including variations of the domain order or using middle linkers with varying length or flexibility were employed to allow soluble expression in bacteria. A few studies have reported expression of soluble tandem scFv molecules in bacteria (see Leung et al. (2000) J. Immunol. 164(12): 6495-502; Ito et al. (2003) J. Immunol. 170(9): 4802-9; Kann et al. (2002) J. Neuroimmunol. 125 (1-2): 134-40) using either a very short Ala3 linker or long glycine/serine-rich linkers. In another study, phage display of a tandem scFv repertoire containing randomized middle linkers with a length of 3 or 6 residues was employed to enrich for those molecules that are produced in soluble and active form in bacteria. This approach resulted in the isolation of a tandem scFv molecule with a 6 amino acid residue linker (see Arndt and Krauss (2003) Methods Mol. Biol. 207: 305-21). It is unclear whether this linker sequence represents a general solution to the soluble expression of tandem scFv molecules. Nevertheless, this study demonstrated that phage display of tandem scFv molecules in combination with directed mutagenesis is a powerful tool to enrich for these molecules, which can be expressed in bacteria in an active form.

Bispecific diabodies (Db) utilize the diabody format for expression. Diabodies are produced from scFv fragments by reducing the length of the linker connecting the VH and VL domain to approximately 5 residues (see Peipp and Valerius (2002) Biochem. Soc. Trans. 30(4): 507-11). This reduction of linker size facilitates dimerization of two polypeptide chains by crossover pairing of the VH and VL domains. Bispecific diabodies are produced by expressing two polypeptide chains with either the structure VHA-VLB and VHB-VLA (VH-VL configuration), or VLA-VHB and VLB-VHA (VL-VH configuration) within the same cell. A large variety of different bispecific diabodies have been produced in the past and most of them can be expressed in soluble form in bacteria. However, a comparative study demonstrated that the orientation of the variable domains can influence expression and formation of active binding sites (see Mack et al. (1995) Proc. Natl. Acad. Sci. USA 92(15): 7021-5). Nevertheless, soluble expression in bacteria represents an important advantage over tandem scFv molecules. However, since two different polypeptide chains are expressed within a single cell inactive homodimers can be produced together with active heterodimers. This necessitates the implementation of additional purification steps in order to obtain homogenous preparations of bispecific diabodies. One approach to force the generation of bispecific diabodies is the production of knob-into-hole diabodies (see Holliger et al. (1993) Proc. Natl. Acad. Sci. USA 90(14): 6444-8.18). This approach was demonstrated for a bispecific diabody directed against HER2 and CD3. A large knob was introduced in the VH domain by exchanging Val37 with Phe and Leu45 with Trp and a complementary hole was produced in the VL domain by mutating Phe98 to Met and Tyr87 to Ala, either in the anti-HER2 or the anti-CD3 variable domains. By using this approach the production of bispecific diabodies could be increased from 72% by the parental diabody to over 90% by the knob-into-hole diabody. Importantly, production yields only slightly decreased as a result of these mutations. However, a reduction in antigen-binding activity was observed for several analyzed constructs. Thus, this rather elaborate approach requires the analysis of various constructs in order to identify those mutations that produce heterodimeric molecule with unaltered binding activity. In addition, such approach requires mutational modification of the immunoglobulin sequence at the constant region, thus creating non-native and non-natural form of the antibody sequence, which may result in increased immunogenicity, poor in vivo stability, as well as undesirable pharmacokinetics.

Single-chain diabodies (scDb) represent an alternative strategy for improving the formation of bispecific diabody-like molecules (see Holliger and Winter (1997) Cancer Immunol. Immunother. 45(3-4): 128-30; Wu et al. (1996) Immunotechnology 2(1): 21-36). Bispecific single-chain diabodies are produced by connecting the two diabody-forming polypeptide chains with an additional middle linker with a length of approximately 15 amino acid residues. Consequently, all molecules with a molecular weight corresponding to monomeric single-chain diabodies (50-60 kDa) are bispecific. Several studies have demonstrated that bispecific single chain diabodies are expressed in bacteria in soluble and active form with the majority of purified molecules present as monomers (see Holliger and Winter (1997) Cancer Immunol. Immunother. 45(3-4): 128-30; Wu et al. (1996) Immunotechnol. 2(1): 21-36; Pluckthun and Pack (1997) Immunotechnol. 3(2): 83-105; Ridgway et al. (1996) Protein Engin. 9(7): 617-21). Thus, single-chain diabodies combine the advantages of tandem scFvs (all monomers are bispecific) and diabodies (soluble expression in bacteria).

More recently diabodies have been fused to Fc to generate more Ig-like molecules, named di-diabodies (see Lu et al. (2004) J. Biol. Chem. 279(4): 2856-65). In addition, multivalent antibody construct comprising two Fab repeats in the heavy chain of an IgG and capable of binding four antigen molecules has been described (see PCT Publication No. WO 0177342 and Miller et al. (2003) J. Immunol. 170(9): 4854-61).

TNF (also referred to as tumor necrosis factor, tumor necrosis factor-alpha, tumor necrosis factor-α, TNF-α, and cachectin) is a cytokine involved in the regulation of immune responses. It plays a critical role in the pathology associated with a variety of diseases involving immune and inflammatory elements, such as autoimmune diseases, particularly those associated with inflammation. Therefore, the binding proteins herein may be used to treat these disorders. It is also involved in respiratory disorders; inflammatory and/or autoimmune conditions of various organs; tumors or cancers; and various types of viral, bacterial and parasitic infections.

Interleukin-17 (IL-17) is a cytokine secreted by activated T-cells, which acts as a potent mediator in immune responses by inducing immune signaling molecules in various tissues to recruit monocytes and neutrophils to the site of inflammation. It acts synergistically with TNF to carry out its functions. IL-17 has been linked to many immune/autoimmune related diseases including rheumatoid arthritis, asthma, lupus, allograft rejection and anti-tumor immunity.

There is a need in the art for improved multivalent binding proteins capable of binding TNF. U.S. Pat. No. 7,612,181 provides a novel family of binding proteins capable of binding two or more antigens with high affinity, which are called dual variable domain binding proteins (DVD-binding protein). Novel binding proteins that bind TNF are provided.

BRIEF SUMMARY OF THE INVENTION

Multivalent binding proteins capable of binding TNF and IL17 are provided. A novel family of binding proteins capable of binding TNF and IL17 with high affinity are provided. In one embodiment, binding proteins that bind TNF comprising a polypeptide chain, wherein the polypeptide chain comprises VD1-(X1)n-VD2-C-(X2)n, wherein VD1 is a first variable domain, VD2 is a second variable domain, C is a constant domain, X1 represents an amino acid or polypeptide, X2 represents an Fc region and n is 0 or 1, are provided. In an embodiment the VD1 and VD2 in the binding protein are heavy chain variable domains. In another embodiment, the heavy chain variable domain is a murine heavy chain variable domain, a human heavy chain variable domain, a CDR grafted heavy chain variable domain, or a humanized heavy chain variable domain. In yet another, embodiment VD1 and VD2 are capable of binding the same antigen. In another embodiment VD1 and VD2 are capable of binding different antigens. In still another embodiment, C is a heavy chain constant domain. In an embodiment, X1 is a linker with the proviso that X1 is not CH1. In an embodiment, X1 is a linker comprising the amino acid sequence AKTTPKLEEGEFSEAR (SEQ ID NO: 1); AKTTPKLEEGEFSEARV (SEQ ID NO: 2); AKTTPKLGG (SEQ ID NO: 3); SAKTTPKLGG (SEQ ID NO: 4); SAKTTP (SEQ ID NO: 5); RADAAP (SEQ ID NO: 6); RADAAPTVS (SEQ ID NO: 7); RADAAAAGGPGS (SEQ ID NO: 8); RADAAAA($G_4$S)$_4$ (SEQ ID NO: 9), SAKTTPKLEEGEFSEARV (SEQ ID NO: 10); ADAAP (SEQ ID NO: 11); ADAAPTVSIFPP (SEQ ID NO: 12); TVAAP (SEQ ID NO: 13); TVAAPSVFIFPP (SEQ ID NO: 14); QPKAAP (SEQ ID NO: 15); QPKAAPSVTLFPP (SEQ ID NO: 16); AKTTPP (SEQ ID NO: 17); AKTTPPSVTPLAP (SEQ ID NO: 18); AKTTAP (SEQ ID NO: 19); AKTTAPSVYPLAP (SEQ ID NO: 20); ASTKGP (SEQ ID NO: 21); ASTKGPSVFPLAP (SEQ ID NO: 22), GGGGSGGGGSGGGGS (SEQ ID NO: 23); GENKVEYAPALMALS (SEQ ID NO: 24); GPAKELTPLKEAKVS (SEQ ID NO: 25); or GHEAAAVMQVQYPAS (SEQ ID NO: 26); TVAAPSVFIFPPTVAAPSVFIFPP (SEQ ID NO: 27); and ASTKGPSVFPLAPASTKGPSVFPLAP (SEQ ID NO: 28). In an embodiment, X2 is an Fc region. In another embodiment, X2 is a variant Fc region.

In an embodiment the binding protein disclosed herein comprises a polypeptide chain that binds TNF, wherein the polypeptide chain comprises VD1-(X1)n-VD2-C—(X2)n, wherein VD1 is a first heavy chain variable domain, VD2 is a second heavy chain variable domain, C is a heavy chain constant domain, X1 is a linker with the proviso that it is not CHL and X2 is an Fc region.

In an embodiment, VD1 and VD2 in the binding protein are light chain variable domains. In an embodiment, the light chain variable domain is a murine light chain variable domain, a human light chain variable domain, a CDR grafted light chain variable domain, or a humanized light chain variable domain. In one embodiment VD1 and VD2 are capable of binding the same antigen. In another embodiment VD1 and VD2 are capable of binding different antigens. In an embodiment, C is a light chain constant domain. In an embodiment, X1 is a linker with the proviso that X1 is not CL. In an embodiment, X1 comprises the amino acid sequence AKTTPKLEEGEFSEAR (SEQ ID NO: 1); AKTTPKLEEGEFSEARV (SEQ ID NO: 2); AKTTPKLGG (SEQ ID NO: 3); SAKTTPKLGG (SEQ ID NO: 4); SAK-TTP (SEQ ID NO: 5); RADAAP (SEQ ID NO: 6); RADAAPTVS (SEQ ID NO: 7); RADAAAAGGPGS (SEQ ID NO: 8); RADAAAA(G₄S)₄ (SEQ ID NO: 9), SAKTTP-KLEEGEFSEARV (SEQ ID NO: 10); ADAAP (SEQ ID NO: 11); ADAAPTVSIFPP (SEQ ID NO: 12); TVAAP (SEQ ID NO: 13); TVAAPSVFIFPP (SEQ ID NO: 14); QPKAAP (SEQ ID NO: 15); QPKAAPSVTLFPP (SEQ ID NO: 16); AKTTPP (SEQ ID NO: 17); AKTTPPSVTPLAP (SEQ ID NO: 18); AKTTAP (SEQ ID NO: 19); AKTTAPS-VYPLAP (SEQ ID NO: 20); ASTKGP (SEQ ID NO: 21); ASTKGPSVFPLAP (SEQ ID NO: 22), GGGGSGGGGSGGGGS (SEQ ID NO: 23); GENKVEYA-PALMALS (SEQ ID NO: 24); GPAKELTPLKEAKVS (SEQ ID NO: 25); or GHEAAAVMQVQYPAS (SEQ ID NO: 26); TVAAPSVFIFPPTVAAPSVFIFPP (SEQ ID NO: 27); and ASTKGPSVFPLAPASTKGPSVFPLAP (SEQ ID NO: 28). In an embodiment, the binding protein does not comprise X2.

In an embodiment, both the variable heavy chains and variable light chains comprise the same linker. In another embodiment, the variable heavy chains and variable light chains comprise different linkers. In another embodiment, both the variable heavy chains and variable light chains comprise a short (about 6 amino acids) linker. In another embodiment, both the variable heavy chains and variable light chains comprise a long (greater than 6 amino acids) linker. In another embodiment, the variable heavy chain comprises a short linker and the variable light chain comprises a long linker. In another embodiment, the variable heavy chain comprises a long linker and the variable light chain comprises a short linker.

In an embodiment the binding protein disclosed herein comprises a polypeptide chain that bind TNF, wherein the polypeptide chain comprises VD1-(X1)n-VD2-C—(X2)n, wherein VD1 is a first light chain variable domain, VD2 is a second light chain variable domain, C is a light chain constant domain, X1 is a linker with the proviso that it is not CL, and X2 does not comprise an Fc region.

In another embodiment, a binding protein that binds TNF comprising two polypeptide chains, wherein the first polypeptide chain comprises VD1-(X1)n-VD2-C—(X2)n, wherein VD1 is a first heavy chain variable domain, VD2 is a second heavy chain variable domain, C is a heavy chain constant domain, X1 is a first linker, and X2 is an Fc region; and the second polypeptide chain comprises VD1-(X1)n-VD2-C—(X2)n, wherein VD1 is a first light chain variable domain, VD2 is a second light chain variable domain, C is a light chain constant domain, X1 is a second linker, and X2 does not comprise an Fc region is provided. In some embodiments, the first and second X1 are the same. In other embodiments, the first and second X1 are different. In some embodiments the first X1 is not a CH1 domain. In some embodiments the second X1 is not a CL domain.

In a particular embodiment, the Dual Variable Domain (DVD) binding protein comprises four polypeptide chains, wherein each of the first two polypeptide chains comprises VD1-(X1)n-VD2-C—(X2)n, wherein VD1 is a first heavy chain variable domain, VD2 is a second heavy chain variable domain, C is a heavy chain constant domain, X1 is a first linker, and X2 is an Fc region; and each of the second two polypeptide chain comprises VD1-(X1)n-VD2-C—(X2)n, wherein VD1 is a first light chain variable domain, VD2 is a second light chain variable domain, C is a light chain constant domain, X1 is a second linker, and X2 does not comprise an Fc region. Such a DVD-binding protein has four antigen binding sites. In some embodiments, the first and second X1 are the same. In other embodiments, the first and second X1 are different. In some embodiments the first X1 is not a CH1 domain. In some embodiments the second X1 is not a CL domain. In another embodiment the binding proteins disclosed herein are capable of binding TNF. Accordingly, in some embodiments, the binding proteins comprise at least two variable domain sequences (e.g., VD1 and VD2) capable of binding TNF, in any orientation. In some embodiments, VD1 and VD2 are independently chosen. Therefore, in some embodiments, VD1 and VD2 comprise the same SEQ ID NO and, in other embodiments, VD1 and VD2 comprise different SEQ ID NOS.

In an embodiment, the binding protein comprises VD1 and VD2 heavy chain variable domains, and VD1 and VD2 light chain variable domains, wherein (a) the VD1 or VD2 heavy chain variable domain comprises three CDRs from SEQ ID NO: 541, 551, 561, 571, 581, 591, 601, 606, 611, 616, 621, 626, 631, 636, 643, 653, 661, 671, 681, 691, 701, 711, 721, 731, 741, 753, 763, 771, 776, 781, 786, 791, 796, 801, 805, 807, 809, or any one of 36-41, 48-72, or 88-97, the VD1 or VD2 light chain variable domain comprises three CDRs from SEQ ID NO: 546, 556, 566, 576, 586, 596, 648, 658, 666, 676, 686, 696, 706, 716, 726, 736, 746, 758, 768 or any one of 42-47, 73-87, or 98-107, and the binding protein is capable of binding TNF;

(b) the VD1 and VD2 heavy chain variable domains independently comprise three CDRs from SEQ ID NO: 541, 551, 561, 571, 581, 591, 601, 606, 611, 616, 621, 626, 631, 636, 643, 653, 661, 671, 681, 691, 701, 711, 721, 731, 741, 753, 763, 771, 776, 781, 786, 791, 796, 801, 805, 807, 809, or any one of 36-41, 48-72, or 88-97, the VD1 and VD2 light chain variable domains independently comprise three CDRs from SEQ ID NO: 546, 556, 566, 576, 586, 596, 648, 658, 666, 676, 686, 696, 706, 716, 726, 736, 746, 758, 768 or any one of 42-47, 73-87, or 98-107, and the binding protein is capable of binding TNF; or (c) the VD1 heavy chain variable domain comprises three CDRs from SEQ ID NO: 541, 551, 561, 571, 581, 591, 601, 606, 611, 616, 621, 626, 631, 636, 643, 653, 661, 671, 681, 691, 701, 711, 721, 731, 741, 753, 763, 771, 776, 781, 786, 791, 796, 801, 805, 807, 809, or any one of 36-41, 48-72, or 88-97, and the VD2 heavy chain variable domain comprises three CDRs from SEQ ID NO: 30, 32, 34, 108, 109, 110, 111, 112, 113, 114 115, 121-317, 527-534, 543, 553, 563, 573, 583, 593, 603, 608, 613, 618, 623, 628, 633, 638, 641, 651, 663, 673, 683, 693, 703, 713, 723, 733, 743, 751, 761, 773, 778, 783, 788, 793, 798, 803 or 811; the VD1 light chain variable domain comprises three CDRs from SEQ ID NO: 546, 556, 566, 576, 586, 596, 648, 658, 666, 676, 686, 696, 706, 716, 726, 736, 746, 758, 768 or any one of 42-47, 73-87, or 98-107, and the VD2 light chain variable domain comprises three CDRs from SEQ ID NO: 31, 33, 35, 116, 117, 118, 119, 120, 318-526, 535-539, 548, 558, 568, 578, 588, 598, 646, 656, 668, 678, 688, 698, 708, 718, 728, 738, 748, 756, 766, or 812; or (d) the VD2 heavy chain variable domain comprises three CDRs from SEQ ID NO: 541, 551, 561, 571, 581, 591, 601, 606, 611, 616, 621, 626, 631, 636, 643, 653, 661, 671, 681, 691, 701, 711, 721, 731, 741, 753, 763, 771, 776, 781, 786, 791, 796, 801, 805, 807, 809, or any one of 36-41, 48-72, or 88-97, and the VD1 heavy chain variable domain comprises three CDRs from SEQ ID NO:

30, 32, 34, 108, 109, 110, 111, 112, 113, 114, 115, 121-317, 527-534, 543, 553, 563, 573, 583, 593, 603, 608, 613, 618, 623, 628, 633, 638, 641, 651, 663, 673, 683, 693, 703, 713, 723, 733, 743, 751, 761, 773, 778, 783, 788, 793, 798, 803 or 811; the VD2 light chain variable domain comprises three CDRs from SEQ ID NO: 546, 556, 566, 576, 586, 596, 648, 658, 666, 676, 686, 696, 706, 716, 726, 736, 746, 758, 768 or any one of 42-47, 73-87, or 98-107, and the VD1 light chain variable domain comprises three CDRs from SEQ ID NO: 31, 33, 35, 116, 117, 118, 119, 120, 318-526, 535-539, 548, 558, 568, 578, 588, 598, 646, 656, 668, 678, 688, 698, 708, 718, 728, 738, 748, 756, 766, or 812.

In another embodiment, the binding protein comprises a heavy chain and a light chain sequence as shown in Table 1.

In another embodiment, a binding protein that binds TNF comprising a polypeptide chain, wherein the polypeptide chain comprises VD1-(X1)n-VD2-C—(X2)n, wherein; VD1 is a first heavy chain variable domain obtained from a first parent antibody or antigen binding portion thereof; VD2 is a second heavy chain variable domain obtained from a second parent antibody or antigen binding portion thereof, which can be the same as or different from the first parent antibody; C is a heavy chain constant domain; (X1)n is a linker with the proviso that it is not CHL wherein the (X1)n is either present or absent; and (X2)n is an Fc region, wherein the (X2)n is either present or absent is provided. In an embodiment, the Fc region is absent from the binding protein.

In another embodiment, a binding protein that binds TNF comprising a polypeptide chain, wherein the polypeptide chain comprises VD1-(X1)n-VD2-C—(X2)n, wherein, VD1 is a first light chain variable domain obtained from a first parent antibody or antigen binding portion thereof; VD2 is a second light chain variable domain obtained from a second parent antibody or antigen binding portion thereof, which can be the same as or different from the first parent antibody; C is a light chain constant domain; (X1)n is a linker with the proviso that it is not CL, wherein the (X1)n is either present or absent; and (X2)n does not comprise an Fc region, wherein the (X2)n is either present or absent is provided. In an embodiment, (X2)n is absent from the binding protein.

In another embodiment, the binding protein that binds TNF comprises first and second polypeptide chains, wherein the first polypeptide chain comprises a first VD1-(X1)n-VD2-C—(X2)n, wherein VD1 is a first heavy chain variable domain obtained from a first parent antibody or antigen binding portion thereof; VD2 is a second heavy chain variable domain obtained from a second parent antibody or antigen binding portion thereof, which can be the same as or different from the first parent antibody; C is a heavy chain constant domain; (X1)n is a first linker, wherein the (X1)n is either present or absent; and (X2)n is an Fc region, wherein the (X2)n is either present or absent; and wherein the second polypeptide chain comprises a second VD1-(X1) n-VD2-C—(X2)n, wherein VD1 is a first light chain variable domain obtained from a first parent antibody or antigen binding portion thereof; VD2 is a second light chain variable domain obtained from a second parent antibody or antigen binding portion thereof, which can be the same as or different from the first parent antibody; C is a light chain constant domain; (X1)n is a second linker, wherein the (X1)n is either present or absent; and (X2)n does not comprise an Fc region, wherein the (X2)n is either present or absent. In another embodiment, the binding protein comprises two first polypeptide chains and two second polypeptide chains. In yet another embodiment, (X2)n is absent from the second polypeptide. In some embodiments, the first and second X1 are the same. In other embodiments, the first and second X1 are different. In some embodiments the first X1 is not a CH1 domain. In some embodiments the second X1 is not a CL domain. In still another embodiment, the Fc region, if present in the first polypeptide, is a native sequence Fc region or a variant sequence Fc region. In yet another embodiment, the Fc region is an Fc region from an IgG1, an Fc region from an IgG2, an Fc region from an IgG3, an Fc region from an IgG4, an Fc region from an IgA, an Fc region from an IgM, an Fc region from an IgE, or an Fc region from an IgD.

In another embodiment, the binding protein that binds TNF comprises four polypeptide chains, wherein, first and third polypeptide chains comprise VD1-(X1)n-VD2-C—(X2)n, wherein, VD1 is a first heavy chain variable domain obtained from a first parent antibody or antigen binding portion thereof; VD2 is a second heavy chain variable domain obtained from a second parent antibody or antigen binding portion thereof, which can be the same as or different from the first parent antibody; C is a heavy chain constant domain; (X1)n is a first linker, wherein the (X1)n is either present or absent; and (X2)n is an Fc region, wherein the (X2)n is either present or absent; and wherein second and fourth polypeptide chains comprise VD1-(X1) n-VD2-C—(X2)n, wherein VD1 is a first light chain variable domain obtained from a first parent antibody or antigen binding portion thereof; VD2 is a second light chain variable domain obtained from a second parent antibody or antigen binding portion thereof, which can be the same as or different from the first parent antibody; C is a light chain constant domain; (X1)n is a second linker, wherein the (X1)n is either present or absent; and (X2)n does not comprise an Fc region, wherein the (X2)n is either present or absent. In some embodiments, the first and second X1 are the same. In other embodiments, the first and second X1 are different. In some embodiments the first X1 is not a CH1 domain. In some embodiments the second X1 is not a CL domain.

A method of making a binding protein that binds TNF is provided. In an embodiment, the method of making a binding protein that binds IL-13 and IL-17 comprises the steps of a) obtaining a first parent antibody, or antigen binding portion thereof, that binds IL-13; b) obtaining a second parent antibody, or antigen binding portion thereof, that binds IL-17; c) constructing first and third polypeptide chains comprising VD1-(X1)n-VD2-C—(X2)n, wherein, VD1 is a first heavy chain variable domain of the first parent antibody, or antigen binding portion thereof; VD2 is a second heavy chain variable domain of the second parent antibody, or antigen binding portion thereof, which can be the same as or different from the first parent antibody; C is a heavy chain constant domain; (X1)n is a first linker, wherein the (X1)n is either present or absent; and (X2)n is an Fc region, wherein the (X2)n is either present or absent; d) constructing second and fourth polypeptide chains comprising VD1-(X1)n-VD2-C—(X2)n, wherein, VD1 is a first light chain variable domain of the first parent antibody, or antigen binding portion thereof; VD2 is a second light chain variable domain of the second parent antibody or antigen binding thereof; C is a light chain constant domain; (X1)n is a second linker, wherein the (X1)n is either present or absent; and (X2)n does not comprise an Fc region, wherein the (X2)n is either present or absent; e) expressing the first, second, third and fourth polypeptide chains; such that a binding protein that binds the first and the second antigen is generated. In some embodiments, the first and second X1 are the same. In other embodiments, the first and second X1 are different. In some embodiments the first X1 is not a CH1 domain. In some embodiments the second X1 is not a CL domain.

In still another embodiment, a method of generating a binding protein that binds TNF with desired properties comprising the steps of a) obtaining a first parent antibody or antigen binding portion thereof, that binds a TNF and possessing at least one desired property exhibited by the binding protein; b) obtaining a second parent antibody or antigen binding portion thereof, that binds a second antigen and possessing at least one desired property exhibited by the binding protein; c) constructing first and third polypeptide chains comprising VD1-(X1)n-VD2-C—(X2)n, wherein; VD1 is a first heavy chain variable domain obtained from the first parent antibody or antigen binding portion thereof; VD2 is a second heavy chain variable domain obtained from the second parent antibody or antigen binding portion thereof, which can be the same as or different from the first parent antibody; C is a heavy chain constant domain; (X1)n is a first linker, wherein the (X1)n is either present or absent; and (X2)n is an Fc region, wherein the (X2)n is either present or absent; d) constructing second and fourth polypeptide chains comprising VD1-(X1)n-VD2-C—(X2)n, wherein; VD1 is a first light chain variable domain obtained from the first parent antibody or antigen binding portion thereof; VD2 is a second light chain variable domain obtained from the second parent antibody or antigen binding portion thereof; C is a light chain constant domain; (X1)n is a second linker, wherein the (X1)n is either present or absent; and (X2)n does not comprise an Fc region, wherein the (X2)n is either present or absent; e) expressing the first, second, third and fourth polypeptide chains; such that a Dual Variable Domain Immunoglobulin capable of binding the first and the second antigen with desired properties is generated is provided. In some embodiments, the first and second X1 are the same. In other embodiments, the first and second X1 are different. In some embodiments the first X1 is not a CH1 domain. In some embodiments the second X1 is not a CL domain.

In one embodiment, the VD1 of the first and second polypeptide chains disclosed herein are obtained from the same parent antibody or antigen binding portion thereof. In another embodiment, the VD1 of the first and second polypeptide chains disclosed herein are obtained from different parent antibodies or antigen binding portions thereof. In another embodiment, the VD2 of the first and second polypeptide chains disclosed herein are obtained from the same parent antibody or antigen binding portion thereof. In another embodiment, the VD2 of the first and second polypeptide chains disclosed herein are obtained from different parent antibodies or antigen binding portions thereof.

In one embodiment the first parent antibody or antigen binding portion thereof, and the second parent antibody or antigen binding portion thereof, are the same antibody. In another embodiment the first parent antibody or antigen binding portion thereof, and the second parent antibody or antigen binding portion thereof, are different antibodies.

In one embodiment the first parent antibody or antigen binding portion thereof, binds a first antigen and the second parent antibody or antigen binding portion thereof, binds a second antigen. In a particular embodiment, the first and second antigens are the same antigen. In another embodiment, the parent antibodies bind different epitopes on the same antigen. In another embodiment the first and second antigens are different antigens. In another embodiment, the first parent antibody or antigen binding portion thereof, binds the first antigen with a potency different from the potency with which the second parent antibody or antigen binding portion thereof, binds the second antigen. In yet another embodiment, the first parent antibody or antigen binding portion thereof, binds the first antigen with an affinity different from the affinity with which the second parent antibody or antigen binding portion thereof, binds the second antigen.

In another embodiment the first parent antibody or antigen binding portion thereof, and the second parent antibody or antigen binding portion thereof, are a human antibody, CDR grafted antibody, or humanized antibody. In an embodiment, the antigen binding portions are a Fab fragment, a F(ab')$_2$ fragment, a bivalent fragment comprising two Fab fragments linked by a disulfide bridge at the hinge region, a Fd fragment consisting of the VH and CH1 domains, a Fv fragment consisting of the VL and VH domains of a single arm of an antibody, a dAb fragment, an isolated complementarity determining region (CDR), a single chain antibody, or diabodies.

In another aspect, the invention provides an IL-17 binding protein comprising at least one heavy chain variable region (VH region) comprising:

(a) three complementarity determining regions (CDRs) from any one of SEQ ID NOS: 30, 32, 34, 108-115, 121-317, 527-534, 543, 553, 563, 573, 583, 593, 603, 608, 613, 618, 623, 628, 633, 638, 641, 651, 663, 673, 683, 693, 703, 713, 723, 733, 743, 751, 761, 773, 778, 783, 788, 793, 798, 803, and 811; or (b) any one of SEQ ID NOS: 30, 32, 34, 108-115, 121-317, 527-534, 543, 553, 563, 573, 583, 593, 603, 608, 613, 618, 623, 628, 633, 638, 641, 651, 663, 673, 683, 693, 703, 713, 723, 733, 743, 751, 761, 773, 778, 783, 788, 793, 798, 803, and 811.

In one embodiment, the invention provides an IL-17 binding protein comprising at least one light chain variable regions (VL region) comprising:

(a) three complementarity determining regions (CDRs) from any one of SEQ ID NOS: 31, 33, 35, 116-120, 318-526, 535-539, 548, 558, 568, 578, 588, 598, 646, 656, 668, 678, 688, 698, 708, 718, 728, 738, 748, 756, 766, and 812; or (b) any one of SEQ ID NOS: 31, 33, 35, 116-120, 318-526, 535-539, 548, 558, 568, 578, 588, 598, 646, 656, 668, 678, 688, 698, 708, 718, 728, 738, 748, 756, 766, and 812.

In one embodiment, the invention provides n IL-17 binding protein comprising at least one heavy chain variable region (VH region) and at least one light chain variable region (VL region), wherein the VH region comprises:

(a) three complementarity determining regions (CDRs) from any one of SEQ ID NOS: 30, 32, 34, 108-115, 121-317, 527-534, 543, 553, 563, 573, 583, 593, 603, 608, 613, 618, 623, 628, 633, 638, 641, 651, 663, 673, 683, 693, 703, 713, 723, 733, 743, 751, 761, 773, 778, 783, 788, 793, 798, 803, and 811; or (b) any one of SEQ ID NOS: 30, 32, 34, 108-115, 121-317, 527-534, 543, 553, 563, 573, 583, 593, 603, 608, 613, 618, 623, 628, 633, 638, 641, 651, 663, 673, 683, 693, 703, 713, 723, 733, 743, 751, 761, 773, 778, 783, 788, 793, 798, 803, and 811; and the VL region comprises:

(c) three CDRs from any one of SEQ ID NOS: 31, 33, 35, 116-120, 318-526, 535-539, 548, 558, 568, 578, 588, 598, 646, 656, 668, 678, 688, 698, 708, 718, 728, 738, 748, 756, 766, and 812; or (d) any one of SEQ ID NOS: 31, 33, 35, 116-120, 318-526, 535-539, 548, 558, 568, 578, 588, 598, 646, 656, 668, 678, 688, 698, 708, 718, 728, 738, 748, 756, 766, and 812.

In one embodiment, the binding protein comprises two VH regions and two VL regions.

In one embodiment, the binding protein comprises at least one VH region and at least one VL region comprising a set of amino acid sequences selected from the group consisting of SEQ ID NOS: 30 and 31; 32 and 33; 34 and 35; 108 and 118; 108 and 119; 109 and 116; 110 and 117; 111 and 120; 112 and 117; 113 and 120; 114 and 117; 115 and 117; 527 and 537; 527 and 538; 528 and 535; 529 and 536; 530 and 539; 531 and 536; 532 and 539; 533 and 536; and 534 and 536.

In one embodiment, wherein the binding protein:
(a) modulates a biological function of IL-17;
(b) neutralizes IL-17;
(c) diminishes the ability of IL-17 to bind to its receptor;
(d) diminishes the ability of pro-human IL-17, mature-human IL-17, or truncated-human IL-17 to bind to its receptor; and/or
(e) reduces one or more of IL-17-dependent cytokine production, IL-17-dependent cell killing, IL-17-dependent inflammation, IL-17-dependent bone erosion, and IL-17-dependent cartilage damage.

In one embodiment, wherein the binding protein has an on rate constant (Kon) of at least about $10^2 M^{-1} s^{-1}$; at least about $10^3 M^{-1} s^{-1}$; at least about $10^4 M^{-1} s^{-1}$; at least about $10^5 M^{-1} s^{-1}$; or at least about $10^6 M^{-1} s^{-1}$, as measured by surface plasmon resonance.

In one embodiment, the binding protein has an off rate constant (Koff) of at most about $10^{-3} s^{-1}$; at most about $10^{-4} s^{-1}$; at most about $10^{-5} s^{-1}$; or at most about $10^{-6} s^{-1}$, as measured by surface plasmon resonance.

In one embodiment, the binding protein has a dissociation constant (KD) of at most about $10^{-7}$ M; at most about $10^{-8}$ M; at most about $10^{-9}$ M; at most about $10^{-10}$ M; at most about $10^{-11}$ M; at most about $10^{-12}$ M; or at most about $10^{-13}$ M.

In another aspect, the invention provides a binding protein capable of binding human IL-17, the binding protein comprising:
(a) a heavy chain constant region;
(b) a light chain constant region;
(c) a heavy chain variable region (VH region) comprising an amino acid sequence selected from the group consisting of SEQ ID NO: 30, 32, 34, 108-115, 121-317, 527-534, 543, 553, 563, 573, 583, 593, 603, 608, 613, 618, 623, 628, 633, 638, 641, 651, 663, 673, 683, 693, 703, 713, 723, 733, 743, 751, 761, 773, 778, 783, 788, 793, 798, 803, and 811; and
(d) a light chain variable region (VL region) comprising an amino acid sequence selected from the group consisting of SEQ ID NO: 31, 33, 35, 116-120, 318-526, 535-539, 548, 558, 568, 578, 588, 598, 646, 656, 668, 678, 688, 698, 708, 718, 728, 738, 748, 756, 766, and 812.

In another embodiment the binding protein possesses at least one desired property exhibited by the first parent antibody or antigen binding portion thereof, or the second parent antibody or antigen binding portion thereof. Alternatively, the first parent antibody or antigen binding portion thereof and the second parent antibody or antigen binding portion thereof possess at least one desired property exhibited by the Dual Variable Domain Immunoglobulin. In an embodiment, the desired property is one or more antibody parameters. In another embodiment, the antibody parameters are antigen specificity, affinity to antigen, potency, biological function, epitope recognition, stability, solubility, production efficiency, immunogenicity, pharmacokinetics, bioavailability, tissue cross reactivity, or orthologous antigen binding. In an embodiment the binding protein is multivalent. In another embodiment, the binding protein is multispecific. The multivalent and or multispecific binding proteins described herein have desirable properties particularly from a therapeutic standpoint. For instance, the multivalent and or multispecific binding protein may (1) be internalized (and/or catabolized) faster than a bivalent antibody by a cell expressing an antigen to which the antibodies bind; (2) be an agonist antibody; and/or (3) induce cell death and/or apoptosis of a cell expressing an antigen which the multivalent antibody is capable of binding to. The "parent antibody" which provides at least one antigen binding specificity of the multivalent and or multispecific binding proteins may be one which is internalized (and/or catabolized) by a cell expressing an antigen to which the antibody binds; and/or may be an agonist, cell death-inducing, and/or apoptosis-inducing antibody, and the multivalent and or multispecific binding protein as described herein may display improvement(s) in one or more of these properties. Moreover, the parent antibody may lack any one or more of these properties, but may be endowed with them when constructed as a multivalent binding protein as described herein.

In another embodiment the binding protein has an on rate constant ($K_{on}$) to one or more targets of: at least about $10^2 M^{-1} s^{-1}$; at least about $10^3 M^{-1} s^{-1}$; at least about $10^4 M^{-1} s^{-1}$; at least about $10^5 M^{-1} s^{-1}$; or at least about $10^6 M^{-1} s^{-1}$, as measured by surface plasmon resonance. In an embodiment, the binding protein has an on rate constant ($K_{on}$) to one or more targets between about $10^2 M^{-1} s^{-1}$ and about $10^3 M^{-1} s^{-1}$; between about $10^3 M^{-1} s^{-1}$ and about $10^4 M^{-1} s^{-1}$; between about $10^4 M^{-1} s^{-1}$ and about $10^5 M^{-1} s^{-1}$; or between about $10^5 M^{-1} s^{-1}$ and about $10^6 M^{-1} s^{-1}$, as measured by surface plasmon resonance.

In another embodiment the binding protein has an off rate constant ($K_{off}$) for one or more targets of: at most about $10^{-3} s^{-1}$; at most about $10^{-4} s^{-1}$; at most about $10^{-5} s^{-1}$; or at most about $10^{-6} s^{-1}$, as measured by surface plasmon resonance. In an embodiment, the binding protein has an off rate constant ($K_{off}$) to one or more targets of about $10^{-3} s^{-1}$ to about $10^{-4} s^{-1}$; of about $10^{-4} s^{-1}$ to about $10^{-5} s^{-1}$; or of about $10^{-5} s^{1}$ to about $10^{-6} s^{-1}$, as measured by surface plasmon resonance.

In another embodiment the binding protein has a dissociation constant ($K_D$) to one or more targets of: at most about $10^{-7}$M; at most about $10^{-8}$M; at most about $10^{-9}$M; at most about $10^{-10}$ M; at most about $10^{-11}$M; at most about $10^{42}$M; or at most $10^{43}$M. In an embodiment, the binding protein has a dissociation constant ($K_D$) to its targets of about $10^{-7}$M to about $10^{-8}$M; of about $10^{-8}$M to about $10^{-9}$M; of about $10^{-9}$M to about $10^{-10}$M; of about $10^{-10}$M to about $10^{-11}$M; of about $10^{-11}$M to about $10^{-12}$M; or of about $10^{-12}$ to M about $10^{-13}$M.

In another embodiment, the binding protein described herein is a conjugate further comprising an agent. In another embodiment, the agent is an immunoadhesion molecule, an imaging agent, a therapeutic agent, or a cytotoxic agent. In an embodiment, the imaging agent is a radiolabel, an enzyme, a fluorescent label, a luminescent label, a bioluminescent label, a magnetic label, or biotin. In another embodiment, the radiolabel is: $^3H$ $^{14}C$, $^{35}S$, $^{90}Y$, $^{99}Tc$, $^{111}In$, $^{125}I$, $^{131}I$, $^{177}Lu$, $^{166}Ho$, or $^{153}Sm$. In yet another embodiment, the therapeutic or cytotoxic agent is an anti-metabolite, an alkylating agent, an antibiotic, a growth factor, a cytokine, an anti-angiogenic agent, an anti-mitotic agent, an anthracycline, toxin, or an apoptotic agent.

In another embodiment, the binding protein described herein is a crystallized binding protein and exists as a crystal. In an embodiment, the crystal is a carrier-free pharmaceutical controlled release crystal. In yet another embodiment, the crystallized binding protein has a greater half life in vivo than the soluble counterpart of the binding protein. In still another embodiment, the crystallized binding protein retains biological activity.

In another embodiment, the binding protein described herein is glycosylated. For example, the glycosylation is a human glycosylation pattern.

An isolated nucleic acid encoding any one of the binding proteins disclosed herein is also provided. A further embodiment provides a vector comprising the isolated nucleic acid disclosed herein wherein the vector is pcDNA; pTT (Durocher et al. (2002) Nucleic Acids Res. 30(2); pTT3 (pTT with additional multiple cloning site; pEFBOS (Mizushima and Nagata (1990) Nucleic Acids Res. 18(17); pBV; pJV; pcDNA3.1 TOPO; pEF6 TOPO; pBOS-hCγ1, pHybE or pBJ. In an embodiment, the vector is a vector disclosed in US Patent Publication No. 20090239259.

In another aspect a host cell is transformed with the vector disclosed herein. In an embodiment, the host cell is a prokaryotic cell. In another embodiment, the host cell is *E. coli*. In a related embodiment the host cell is a eukaryotic cell. In another embodiment, the eukaryotic cell is a protist cell, an animal cell, a plant cell, or a fungal cell. In yet another embodiment, the host cell is a mammalian cell including, but not limited to, CHO, COS; NS0, SP2, PER.C6 or a fungal cell, such as *Saccharomyces cerevisiae*, or an insect cell, such as Sf9.

In an embodiment, two or more, e.g., with different specificities, are produced in a single recombinant host cell. For example, the expression of a mixture of antibodies has been called Oligoclonics™, (Merus B. V., The Netherlands) U.S. Pat. Nos. 7,262,028; 7,429,486.

A method of producing a binding protein disclosed herein comprising culturing any one of the host cells also disclosed herein in a culture medium under conditions sufficient to produce the binding protein is provided. In an embodiment, 50%-75% of the binding protein produced by this method is a dual specific tetravalent binding protein. In a particular embodiment, 75%-90% of the binding protein produced by this method is a dual specific tetravalent binding protein. In a particular embodiment, 90%-95% of the binding protein produced is a dual specific tetravalent binding protein.

One embodiment provides a composition for the release of a binding protein wherein the composition comprises a formulation that in turn comprises a crystallized binding protein, as disclosed herein, and an ingredient, and at least one polymeric carrier. For example, the polymeric carrier is: poly (acrylic acid), poly (cyanoacrylates), poly (amino acids), poly (anhydrides), poly (depsipeptide), poly (esters), poly (lactic acid), poly (lactic-co-glycolic acid) or PLGA, poly (b-hydroxybutryate), poly (caprolactone), poly (dioxanone); poly (ethylene glycol), poly ((hydroxypropyl) methacrylamide, poly [(organo)phosphazene], poly (ortho esters), poly (vinyl alcohol), poly (vinylpyrrolidone), maleic anhydride-alkyl vinyl ether copolymers, pluronic polyols, albumin, alginate, cellulose and cellulose derivatives, collagen, fibrin, gelatin, hyaluronic acid, oligosaccharides, glycaminoglycans, sulfated polysaccharides, or blends and copolymers thereof. For example, the ingredient may be albumin, sucrose, trehalose, lactitol, gelatin, hydroxypropyl-β-cyclodextrin, methoxypolyethylene glycol, or polyethylene glycol. Another embodiment provides a method for treating a mammal comprising the step of administering to the mammal an effective amount of the composition disclosed herein.

A pharmaceutical composition comprising a binding protein, as disclosed herein and a pharmaceutically acceptable carrier is provided. In a further embodiment the pharmaceutical composition comprises at least one additional therapeutic agent for treating a disorder. For example, the additional agent may be a therapeutic agent, an imaging agent, a cytotoxic agent, an angiogenesis inhibitor (including but not limited to an anti-VEGF antibody or a VEGF-trap), a kinase inhibitor (including but not limited to a KDR and a TIE-2 inhibitor), a co-stimulation molecule blocker (including but not limited to anti-B7.1, anti-B7.2, CTLA4-Ig, anti-CD20), an adhesion molecule blocker (including but not limited to an anti-LFA-1 antibody, an anti-E/L selectin antibody, a small molecule inhibitor), an anti-cytokine antibody or functional fragment thereof (including but not limited to an anti-IL-18, an anti-TNF, and an anti-IL-6/cytokine receptor antibody), methotrexate, cyclosporin, rapamycin, FK506, a detectable label or reporter, a TNF antagonist, an antirheumatic, a muscle relaxant, a narcotic, a non-steroid anti-inflammatory drug (NSAID), an analgesic, an anesthetic, a sedative, a local anesthetic, a neuromuscular blocker, an antimicrobial, an antipsoriatic, a corticosteriod, an anabolic steroid, an erythropoietin, an immunization, an immunoglobulin, an immunosuppressive, a growth hormone, a hormone replacement drug, a radiopharmaceutical, an antidepressant, an antipsychotic, a stimulant, an asthma medication, a beta agonist, an inhaled steroid, an epinephrine or analog, a cytokine, or a cytokine antagonist.

A method for treating a human subject suffering from a disorder in which the target, or targets, capable of being bound by the binding protein disclosed herein is detrimental, comprising administering to the human subject a binding protein disclosed herein such that the activity of the target, or targets in the human subject is inhibited and one of more symptoms is alleviated or treatment is achieved is provided. In an embodiment, diseases that can be treated or diagnosed with the compositions and methods include, but are not limited to, immune and inflammatory elements, such as autoimmune diseases, particularly those associated with inflammation, including Crohn's disease, psoriasis (including plaque psoriasis), arthritis (including rheumatoid arthritis, psoratic arthritis, osteoarthritis, or juvenile idiopathic arthritis), multiple sclerosis, ankylosing spondylitis, spondylosing arthropathy, systemic lupus erythematosus, uveitis, multiple sclerosis, sepsis, and neurodegenerative diseases, neuronal regeneration, spinal cord injury, and primary and metastatic cancers. In another embodiment, the disorder is a respiratory disorder; asthma; allergic and nonallergic asthma; asthma due to infection; asthma due to infection with respiratory syncytial virus (RSV); chronic obstructive pulmonary disease (COPD); a condition involving airway inflammation; eosinophilia; fibrosis and excess mucus production; cystic fibrosis; pulmonary fibrosis; an atopic disorder; atopic dermatitis; urticaria; eczema; allergic rhinitis; allergic enterogastritis; an inflammatory and/or autoimmune condition of the skin; an inflammatory and/or autoimmune condition of gastrointestinal organs; inflammatory bowel diseases (IBD); ulcerative colitis; Chrohn's disease; an inflammatory and/or autoimmune condition of the liver; liver cirrhosis; liver fibrosis; liver fibrosis caused by hepatitis B and/or C virus; scleroderma; tumors or cancers; hepatocellular carcinoma; glioblastoma; lymphoma; Hodgkin's lymphoma; a viral infection; a bacterial infection; a parasitic infection; HTLV-1 infection; suppression of expression of protective type 1 immune responses, and suppression of expression of a protective type 1 immune response during vaccination.

In an embodiment, the antibodies or antigen-binding portions thereof, are used to treat cancer or in the prevention or inhibition of metastases from the tumors described herein either when used alone or in combination with radiotherapy and/or other chemotherapeutic agents.

In another aspect a method of treating a patient suffering from a disorder comprising the step of administering any one of the binding proteins disclosed herein before, concurrently, or after the administration of a second agent, as discussed herein is provided. In a particular embodiment the second agent is budenoside, epidermal growth factor, corticosteroids, cyclosporin, sulfasalazine, aminosalicylates, 6-mercaptopurine, azathioprine, metronidazole, lipoxygenase inhibitors, mesalamine, olsalazine, balsalazide, antioxidants, thromboxane inhibitors, IL-1 receptor antagonists, anti-IL-1β mAbs, anti-IL-6 or IL-6 receptor mAbs, growth factors, elastase inhibitors, pyridinyl-imidazole compounds, antibodies or agonists of TNF, LT, IL-1, IL-2, IL-6, IL-7, IL-8, IL-12, IL-13, IL-15, IL-16, IL-18, IL-23, EMAP-II, GM-CSF, FGF, and PDGF, antibodies of CD2, CD3, CD4, CD8, CD-19, CD25, CD28, CD30, CD40, CD45, CD69, CD90 or their ligands, methotrexate, cyclosporin, FK506, rapamycin, mycophenolate mofetil, leflunomide, NSAIDs, ibuprofen, corticosteroids, prednisolone, phosphodiesterase inhibitors, adensosine agonists, antithrombotic agents, complement inhibitors, adrenergic agents, IRAK, NIK, IKK, p38, MAP kinase inhibitors, IL-1β converting enzyme inhibitors, TNFα-converting enzyme inhibitors, T-cell signalling inhibitors, metalloproteinase inhibitors, sulfasalazine, azathioprine, 6-mercaptopurines, angiotensin converting enzyme inhibitors, soluble cytokine receptors, soluble p55 TNF receptor, soluble p75 TNF receptor, sIL-1RI, sIL-1RII, sIL-6R, antiinflammatory cytokines, IL-4, IL-10, IL-11, IL-13, or TGFβ. In a particular embodiment the pharmaceutical compositions disclosed herein are administered to the patient by parenteral, subcutaneous, intramuscular, intravenous, intrarticular, intrabronchial, intraabdominal, intracapsular, intracartilaginous, intracavitary, intracelial, intracerebellar, intracerebroventricular, intracolic, intracervical, intragastric, intrahepatic, intramyocardial, intraosteal, intrapelvic, intrapericardiac, intraperitoneal, intrapleural, intraprostatic, intrapulmonary, intrarectal, intrarenal, intraretinal, intraspinal, intrasynovial, intrathoracic, intrauterine, intravesical, bolus, vaginal, rectal, buccal, sublingual, intranasal, or transdermal administration. At least one anti-idiotype antibody to at least one binding protein are also provided. The anti-idiotype antibody includes any protein or peptide containing molecule that comprises at least a portion of an immunoglobulin molecule such as, but not limited to, at least one complementarily determining region (CDR) of a heavy or light chain or a ligand binding portion thereof, a heavy chain or light chain variable region, a heavy chain or light chain constant region, a framework region, or any portion thereof, that can be incorporated into a binding protein provided herein.

A method of determining the presence, amount or concentration of TNF (or a fragment thereof) in a test sample is provided. The method comprises assaying the test sample for the antigen (or a fragment thereof) by an immunoassay. The immunoassay (i) employs at least one binding protein and at least one detectable label and (ii) comprises comparing a signal generated by the detectable label as a direct or indirect indication of the presence, amount or concentration of the antigen (or a fragment thereof) in the test sample to a signal generated as a direct or indirect indication of the presence, amount or concentration of the antigen (or a fragment thereof) in a control or a calibrator. The calibrator is optionally part of a series of calibrators in which each of the calibrators differs from the other calibrators in the series by the concentration of the antigen (or a fragment thereof). One of the at least one binding protein comprises the binding protein, such as the DVD-binding protein, disclosed herein. The method can comprise (i) contacting the test sample with at least one capture agent, which binds to an epitope on the antigen (or a fragment thereof) so as to form a capture agent/antigen (or a fragment thereof) complex, (ii) contacting the capture agent/antigen (or a fragment thereof) complex with at least one detection agent, which comprises a detectable label and binds to an epitope on the antigen (or a fragment thereof) that is not bound by the capture agent, to form a capture agent/antigen (or a fragment thereof)/detection agent complex, and (iii) determining the presence, amount or concentration of the antigen (or a fragment thereof) in the test sample based on the signal generated by the detectable label in the capture agent/antigen (or a fragment thereof)/detection agent complex formed in (ii), wherein at least one capture agent and/or at least one detection agent is the at least one binding protein.

Alternatively, the method can comprise (i) contacting the test sample with at least one capture agent, which binds to an epitope on the antigen (or a fragment thereof) so as to form a capture agent/antigen (or a fragment thereof) complex, and simultaneously or sequentially, in either order, contacting the test sample with detectably labeled antigen (or a fragment thereof), which can compete with any antigen (or a fragment thereof) in the test sample for binding to the at least one capture agent, wherein any antigen (or a fragment thereof) present in the test sample and the detectably labeled antigen compete with each other to form a capture agent/antigen (or a fragment thereof) complex and a capture agent/detectably labeled antigen (or a fragment thereof) complex, respectively, and (ii) determining the presence, amount or concentration of the antigen (or a fragment thereof) in the test sample based on the signal generated by the detectable label in the capture agent/detectably labeled antigen (or a fragment thereof) complex formed in (ii), wherein at least one capture agent is the at least one binding protein and wherein the signal generated by the detectable label in the capture agent/detectably labeled antigen (or a fragment thereof) complex is inversely proportional to the amount or concentration of antigen (or a fragment thereof) in the test sample.

In some embodiments, the methods disclosed herein comprises assaying the test sample for the antigen (or a fragment thereof) by an immunoassay. The immunoassay (i) employs at least one binding protein and at least one detectable label and (ii) comprises comparing a signal generated by the detectable label as a direct or indirect indication of the presence, amount or concentration of the antigen (or a fragment thereof) in the test sample to a signal generated as a direct or indirect indication of the presence, amount or concentration of the antigen (or a fragment thereof) in a control or a calibrator. The calibrator is optionally part of a series of calibrators in which each of the calibrators differs from the other calibrators in the series by the concentration of the antigen (or a fragment thereof). One of the at least one binding protein comprises the binding porotein, such as the DVD-binding protein, disclosed herein.

If the test sample is from a patient, the methods disclosed herein can further comprise diagnosing, prognosticating, or assessing the efficacy of therapeutic/prophylactic treatment of the patient. If the methods further comprises assessing the efficacy of therapeutic/prophylactic treatment of the patient, the methods optionally further comprises modifying the therapeutic/prophylactic treatment of the patient as needed to improve efficacy. The methods disclosed herein can be adapted for use in an automated system or a semi-automated system.

Also provided is a kit for assaying a test sample for an antigen (or a fragment thereof). The kit comprises at least one component for assaying the test sample for an antigen (or a fragment thereof) and instructions for assaying the test sample for an antigen (or a fragment thereof), wherein the at least one component includes at least one composition comprising a binding protein disclosed herein.

BRIEF DESCRIPTION OF THE DRAWINGS

FIG. 1A is a schematic representation of Dual Variable Domain (DVD) constructs and shows the strategy for generation of a DVD-binding protein from two parent antibodies.

FIG. 1B is a schematic representation of constructs DVD1-Ig, DVD2-Ig, and two chimeric mono-specific antibody clones.

DETAILED DESCRIPTION OF THE INVENTION

Multivalent and/or multispecific binding proteins capable of binding two or more antigens are provided. Dual variable domain binding proteins (DVD-binding proteins), and pharmaceutical compositions thereof, as well as nucleic acids, recombinant expression vectors and host cells for making such DVD-binding proteins. Methods of using the DVD-binding proteins to detect specific antigens, either in vitro or in vivo are also provided.

Unless otherwise defined herein, scientific and technical terms used herein have the meanings that are commonly understood by those of ordinary skill in the art. In the event of any latent ambiguity, definitions provided herein take precedent over any dictionary or extrinsic definition. Unless otherwise required by context, singular terms shall include pluralities and plural terms shall include the singular. The use of "or" means "and/or" unless stated otherwise. The use of the term "including", as well as other forms, such as "includes" and "included", is not limiting. Terms such as "element" or "component" encompass both elements and components comprising one unit and elements and components that comprise more than one subunit unless specifically stated otherwise.

Generally, nomenclatures used in connection with cell and tissue culture, molecular biology, immunology, microbiology, genetics and protein and nucleic acid chemistry and hybridization described herein are those well known and commonly used in the art. The methods and techniques provided herein are generally performed according to conventional methods well known in the art and as described in various general and more specific references that are cited and discussed throughout the present specification unless otherwise indicated. Enzymatic reactions and purification techniques are performed according to manufacturer's specifications, as commonly accomplished in the art or as described herein. The nomenclatures used in connection with, and the laboratory procedures and techniques of, analytical chemistry, synthetic organic chemistry, and medicinal and pharmaceutical chemistry described herein are those well known and commonly used in the art. Standard techniques are used for chemical syntheses, chemical analyses, pharmaceutical preparation, formulation, and delivery, and treatment of patients.

That the disclosure may be more readily understood, select terms are defined below.

The term "antibody" broadly refers to any immunoglobulin (Ig) molecule comprised of four polypeptide chains, two heavy (H) chains and two light (L) chains, or any functional fragment, mutant, variant, or derivation thereof, which retains the essential epitope binding features of an Ig molecule. Such mutant, variant, or derivative antibody formats are known in the art, and nonlimiting embodiments thereof are discussed herein.

In a full-length antibody, each heavy chain is comprised of a heavy chain variable region (abbreviated herein as HCVR or VH) and a heavy chain constant region. The heavy chain constant region is comprised of three domains, CH1, CH2 and CH3. Each light chain is comprised of a light chain variable region (abbreviated herein as LCVR or VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, and FR4. Immunoglobulin molecules can be of any type (e.g., IgG, IgE, IgM, IgD, IgA and IgY), class (e.g., IgG 1, IgG2, IgG 3, IgG4, IgA1 and IgA2), or subclass.

The term "Fc region" is used to define the C-terminal region of an immunoglobulin heavy chain, which may be generated by papain digestion of an intact antibody. The Fc region may be a native sequence Fc region or a variant Fc region. The Fc region of an immunoglobulin generally comprises two constant domains, a CH2 domain and a CH3 domain, and optionally comprises a CH4 domain. Replacements of amino acid residues in the Fc portion to alter antibody effector function are known in the art (U.S. Pat. Nos. 5,648,260 and 5,624,821). The Fc portion of an antibody mediates several important effector functions, e.g., cytokine induction, ADCC, phagocytosis, complement dependent cytotoxicity (CDC), and half-life/clearance rate of antibody and antigen-antibody complexes. In some cases these effector functions are desirable for a therapeutic antibody but in other cases might be unnecessary or even deleterious, depending on the therapeutic objectives. Certain human IgG isotypes, particularly IgG1 and IgG3, mediate ADCC and CDC via binding to FcγRs and complement C1q, respectively. Neonatal Fc receptors (FcRn) are the critical components determining the circulating half-life of antibodies. In still another embodiment at least one amino acid residue is replaced in the constant region of the antibody, for example the Fc region of the antibody, such that effector functions of the antibody are altered. The dimerization of two identical heavy chains of an immunoglobulin is mediated by the dimerization of CH3 domains and is stabilized by the disulfide bonds within the hinge region (Huber et al. (1976) Nature 264: 415-20; Thies et al. (1999) J. Mol. Biol. 293: 67-79). Mutation of cysteine residues within the hinge regions to prevent heavy chain-heavy chain disulfide bonds will destabilize dimeration of CH3 domains. Residues responsible for CH3 dimerization have been identified (Dall'Acqua (1998) Biochem. 37: 9266-73.). Therefore, it is possible to generate a monovalent half-Ig. Interestingly, these monovalent half Ig molecules have been found in nature for both IgG and IgA subclasses (Seligman (1978) Ann. Immunol. 129: 855-70; Biewenga et al. (1983) Clin. Exp. Immunol. 51: 395-400). The stoichiometry of FcRn: Ig Fc region has been determined to be 2:1 (West et al. (2000) Biochem. 39: 9698-708), and half Fc is sufficient for mediating FcRn binding (Kim et al. (1994) Eur. J. Immunol. 24: 542-548.). Mutations to disrupt the dimerization of CH3 domain may not have greater adverse effect on its FcRn binding as the residues important for CH3 dimerization are located on the inner interface of CH3 b sheet structure, whereas the region responsible for FcRn binding is located on the outside interface of CH2-CH3 domains. However the half Ig molecule may have certain advantages in tissue penetration due to its smaller size than that of a regular antibody. In one embodiment at least one amino acid residue is replaced in the constant region of the binding proteins provided herein, for example the Fc region, such that the dimerization of the heavy chains is disrupted, resulting in half DVD-binding protein molecules. The anti-inflammatory activity of IgG is dependent on sialylation of the N-linked glycan of the IgG Fc fragment. The precise glycan requirements for anti-inflammatory activity has been determined, such that an appropriate IgG1 Fc fragment can be created, thereby generating a fully recombinant, sialylated IgG1 Fc with greatly enhanced potency (Anthony et al. (2008) Science 320:373-376).

The term "antigen-binding portion" of an antibody refers to one or more fragments of an antibody that retain the ability to specifically bind to an antigen. It has been shown that the antigen-binding function of an antibody can be performed by fragments of a full-length antibody. Such antibody embodiments may also be bispecific, dual specific, or multi-specific formats; specifically binding to two or more different antigens. Examples of binding fragments encompassed within the term "antigen-binding portion" of an antibody include (i) a Fab fragment, a monovalent fragment consisting of the VL, VH, CL and CH1 domains; (ii) a F(ab')$_2$ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al. (1989) Nature 341:544-546, PCT Publication No. WO 90/05144), which comprises a single variable domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv (scFv); see e.g., Bird et al. (1988) Science 242:423-426; and Huston et al. (1988) Proc. Natl. Acad. Sci. USA 85:5879-5883). Such single chain antibodies are also intended to be encompassed within the term "antigen-binding portion" of an antibody. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see e.g., Holliger et al. (1993) Proc. Natl. Acad. Sci. USA 90:6444-6448; Poljak et al. (1994) Structure 2:1121-1123). Such antibody binding portions are known in the art (Kontermann and Dubel eds., Antibody Engineering (2001) Springer-Verlag. New York. 790 pp. (ISBN 3-540-41354-5). In addition single chain antibodies also include "linear antibodies" comprising a pair of tandem Fv segments (VH-CH1-VH-CH1) which, together with complementary light chain polypeptides, form a pair of antigen binding regions (Zapata et al. (1995) Protein Eng. 8(10):1057-1062; and U.S. Pat. No. 5,641,870).

The term "multivalent binding protein" is used throughout this specification to denote a binding protein comprising two or more antigen binding sites. In an embodiment, the multivalent binding protein is engineered to have the three or more antigen binding sites, and is generally not a naturally occurring antibody. The term "multispecific binding protein" refers to a binding protein capable of binding two or more related or unrelated targets. Dual variable domain (DVD) binding proteins provided herein comprise two or more antigen binding sites and are tetravalent or multivalent binding proteins. DVD-binding proteins may be monospecific, i.e., capable of binding one antigen or multispecific, i.e. capable of binding two or more antigens. DVD-binding proteins comprising two heavy chain DVD polypeptides and two light chain DVD polypeptides are referred to as DVD. Each half of a DVD-binding protein comprises a heavy chain DVD polypeptide, and a light chain DVD polypeptide, and two antigen binding sites. Each binding site comprises a heavy chain variable domain and a light chain variable domain with a total of 6 CDRs involved in antigen binding per antigen binding site.

The term "bispecific antibody" refers to full-length antibodies that are generated by quadroma technology (see Milstein and Cuello (1983) Nature 305(5934): 537-40), by chemical conjugation of two different monoclonal antibodies (see Staerz et al. (1985) Nature 314(6012): 628-31), or by knob-into-hole or similar approaches which introduces mutations in the Fc region (see Holliger et al. (1993) Proc. Natl. Acad. Sci. USA 90(14): 6444-6448), resulting in multiple different immunoglobulin species of which only one is the functional bispecific antibody. By molecular function, a bispecific antibody binds one antigen (or epitope) on one of its two binding arms (one pair of HC/LC), and binds a different antigen (or epitope) on its second arm (a different pair of HC/LC). By this definition, a bispecific antibody has two distinct antigen binding arms (in both specificity and CDR sequences), and is monovalent for each antigen to which it binds.

The term "dual-specific antibody" refers to full-length antibodies that can bind two different antigens (or epitopes) in each of its two binding arms (a pair of HC/LC) (see PCT Publication No. WO 02/02773). Accordingly a dual-specific binding protein has two identical antigen binding arms, with identical specificity and identical CDR sequences, and is bivalent for each antigen to which it binds.

A "functional antigen binding site" of a binding protein is one that is capable of binding a target antigen. The antigen binding affinity of the antigen binding site is not necessarily as strong as the parent antibody from which the antigen binding site is derived, but the ability to bind antigen may be measurable using any one of a variety of methods known for evaluating antibody binding to an antigen. Moreover, the antigen binding affinity of each of the antigen binding sites of a multivalent antibody herein need not be quantitatively the same.

The term "linker" is used to denote polypeptides comprising two or more amino acid residues joined by peptide bonds and are used to link one or more antigen binding portions. Such linker polypeptides are well known in the art (see e.g., Holliger et al. (1993) Proc. Natl. Acad. Sci. USA 90:6444-6448; Poljak et al. (1994) Structure 2:1121-1123).

An "immunoglobulin constant domain" refers to a heavy or light chain constant domain. Human IgG heavy chain and light chain constant domain amino acid sequences are known in the art.

The term "monoclonal antibody" or "mAb" refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigen. Furthermore, in contrast to polyclonal antibody preparations that typically include different antibodies directed against different determinants (epitopes), each mAb is directed against a single determinant on the antigen. The modifier "monoclonal" is not to be construed as requiring production of the antibody by any particular method.

The term "human antibody" includes antibodies having variable and constant regions derived from human germline immunoglobulin sequences. The human antibodies provided herein may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody" does not include antibodies in which CDR sequences derived from the germline of another mammalian species, such as a mouse, have been grafted onto human framework sequences.

The term "recombinant human antibody", as used herein, is intended to include all human antibodies that are prepared, expressed, created or isolated by recombinant means, such as antibodies expressed using a recombinant expression vector transfected into a host cell, antibodies isolated from a recombinant, combinatorial human antibody library (Hoogenboom H. R. (1997) TIB Tech. 15:62-70; Azzazy H., and Highsmith W. E. (2002) Clin. Biochem. 35:425-445; Gavilondo J. V., and Larrick J. W. (2002) BioTechniques 29:128-145; Hoogenboom H., and Chames P. (2000) Immunology Today 21:371-378), antibodies isolated from an animal (e.g., a mouse) that is transgenic for human immunoglobulin genes (see, Taylor, L. D., et al. (1992) Nucl. Acids Res. 20:6287-6295; Kellermann S-A. and Green L. L. (2002) Current Opinion in Biotechnology 13:593-597; Little M. et al. (2000) Immunology Today 21:364-370) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo.

An "affinity matured" antibody is an antibody with one or more alterations in one or more CDRs thereof which result an improvement in the affinity of the antibody for antigen, compared to a parent antibody which does not possess those alteration(s). Exemplary affinity matured antibodies will have nanomolar or even picomolar affinities for the target antigen. Affinity matured antibodies are produced by procedures known in the art. Marks et al. (1992) BioTechnology 10:779-783 describes affinity maturation by VH and VL domain shuffling. Random mutagenesis of CDR and/or framework residues is described by: e.g. Barbas et al. (1994) Proc. Nat. Acad. Sci, USA 91:3809-3813 and selective mutation at selective mutagenesis positions, contact or hypermutation positions with an activity enhancing amino acid residue as described in U.S. Pat. No. 6,914,128.

The term "chimeric antibody" refers to antibodies which comprise heavy and light chain variable region sequences from one species and constant region sequences from another species, such as antibodies having murine heavy and light chain variable regions linked to human constant regions.

The term "CDR-grafted antibody" refers to antibodies which comprise heavy and light chain variable region sequences from one species but in which the sequences of one or more of the CDR regions of VH and/or VL are replaced with CDR sequences of another species, such as antibodies having murine heavy and light chain variable regions in which one or more of the murine CDRs (e.g., CDR3) has been replaced with human CDR sequences. The term "humanized antibody" refers to antibodies which comprise heavy and light chain variable region sequences from a non-human species (e.g., a mouse) but in which at least a portion of the VH and/or VL sequence has been altered to be more "human-like", i.e., more similar to human germline variable sequences. One type of humanized antibody is a CDR-grafted antibody, in which human CDR sequences are introduced into non-human VH and VL sequences to replace the corresponding nonhuman CDR sequences. Also "humanized antibody" is an antibody or a variant, derivative, analog or fragment thereof which immunospecifically binds to an antigen of interest and which comprises a framework (FR) region having substantially the amino acid sequence of a human antibody and a CDR having substantially the amino acid sequence of a non-human antibody. The term "substantially" in the context of a CDR refers to a CDR having an amino acid sequence at least 80%, at least 85%, at least 90%, at least 95%, at least 98% or at least 99% identical to the amino acid sequence of a non-human antibody CDR. A humanized antibody comprises substantially all of at least one, and typically two, variable domains (Fab, Fab', F(ab')2, FabC, Fv) in which all or substantially all of the CDR regions correspond to those of a non-human immunoglobulin (i.e., donor antibody) and all or substantially all of the FR regions are those of a human immunoglobulin consensus sequence. In an embodiment, a humanized antibody also comprises at least a portion of an immunoglobulin Fc region, typically that of a human immunoglobulin. In some embodiments, a humanized antibody contains both the light chain as well as at least the variable domain of a heavy chain. The antibody also may include the CH1, hinge, CH2, CH3, and CH4 regions of the heavy chain. In some embodiments, a humanized antibody only contains a humanized light chain. In some embodiments, a humanized antibody only contains a humanized heavy chain. In specific embodiments, a humanized antibody only contains a humanized variable domain of a light chain and/or humanized heavy chain.

The terms "Kabat numbering", "Kabat definitions" and "Kabat labeling" are used interchangeably herein. These terms, which are recognized in the art, refer to a system of numbering amino acid residues which are more variable (i.e. hypervariable) than other amino acid residues in the heavy and light chain variable regions of an antibody, or an antigen binding portion thereof (Kabat et al. (1971) Ann. NY Acad., Sci. 190:382-391 and, Kabat, E. A., et al. (1991) Sequences of Proteins of Immunological Interest, Fifth Edition, U.S. Department of Health and Human Services, NIH Publication No. 91-3242). For the heavy chain variable region, the hypervariable region ranges from amino acid positions 31 to 35 for CDR1, amino acid positions 50 to 65 for CDR2, and amino acid positions 95 to 102 for CDR3. For the light chain variable region, the hypervariable region ranges from amino acid positions 24 to 34 for CDR1, amino acid positions 50 to 56 for CDR2, and amino acid positions 89 to 97 for CDR3.

The term "CDR" refers to the complementarity determining region within antibody variable sequences. There are three CDRs in each of the variable regions of the heavy chain and the light chain, which are designated CDR1, CDR2 and CDR3, for each of the variable regions. The term "CDR set" refers to a group of three CDRs that occur in a single variable region capable of binding the antigen. The exact boundaries of these CDRs have been defined differently according to different systems. The system described by Kabat (Kabat et al., Sequences of Proteins of Immunological Interest (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia and Lesk (1987) J. Mol. Biol. 196:901-917; Chothia et al. (1989) Nature 342:877-883) found that certain sub-portions within Kabat CDRs adopt nearly identical peptide backbone conformations, despite having great diversity at the level of amino acid sequence. These sub-portions were designated as L1, L2 and L3 or H1, H2 and H3 where the "L" and the "H" designates the light chain and the heavy chain regions, respectively. These regions may be referred to as Chothia CDRs, which have boundaries that overlap with Kabat CDRs. Other boundaries defining CDRs overlapping with the Kabat CDRs have been described by Padlan (1995) FASEB J. 9:133-139 and MacCallum (1996) J. Mol. Biol. 262(5):732-45. Still other CDR boundary definitions may not strictly follow one of the herein systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems, although certain embodiments use Kabat or Chothia defined CDRs.

The term "framework" or "framework sequence" refers to the remaining sequences of a variable region minus the CDRs. Because the exact definition of a CDR sequence can be determined by different systems, the meaning of a framework sequence is subject to correspondingly different interpretations. The six CDRs (CDR-L1, -L2, and -L3 of light chain and CDR-H1, -H2, and -H3 of heavy chain) also divide the framework regions on the light chain and the heavy chain into four sub-regions (FR1, FR2, FR3 and FR4) on each chain, in which CDR1 is positioned between FR1 and FR2, CDR2 between FR2 and FR3, and CDR3 between FR3 and FR4. Without specifying the particular sub-regions as FR1, FR2, FR3 or FR4, a framework region, as referred by others, represents the combined FR's within the variable region of a single, naturally occurring immunoglobulin chain. A FR represents one of the four sub-regions, and FRs represents two or more of the four sub-regions constituting a framework region.

The term "germline antibody gene" or "gene fragment" refers to an immunoglobulin sequence encoded by non-lymphoid cells that have not undergone the maturation process that leads to genetic rearrangement and mutation for expression of a particular immunoglobulin. (See, e.g., Shapiro et al. (2002) Crit. Rev. Immunol. 22(3): 183-200; Marchalonis et al. (2001) Adv. Exp. Med. Biol. 484:13-30). One of the advantages provided by various embodiments stems from the recognition that germline antibody genes are more likely than mature antibody genes to conserve essential amino acid sequence structures characteristic of individuals in the species, hence less likely to be recognized as from a foreign source when used therapeutically in that species.

The term "neutralizing" refers to counteracting the biological activity of an antigen when a binding protein specifically binds to the antigen. In an embodiment, the neutralizing binding protein binds to the cytokine and reduces its biologically activity by at least about 20%, 40%, 60%, 80%, 85% or more.

The term "activity" includes activities such as the binding specificity and affinity of a DVD-binding protein for two or more antigens.

The term "epitope" includes any polypeptide determinant capable of specific binding to an immunoglobulin or T-cell receptor. In certain embodiments, epitope determinants include chemically active surface groupings of molecules such as amino acids, sugar side chains, phosphoryl, or sulfonyl, and, in certain embodiments, may have specific three dimensional structural characteristics, and/or specific charge characteristics. An epitope is a region of an antigen that is bound by an antibody. An epitope thus consists of the amino acid residues of a region of an antigen (or fragment thereof) known to bind to the complementary site on the specific binding partner. An antigenic fragment can contain more than one epitope. In certain embodiments, an antibody specifically binds an antigen when it recognizes its target antigen in a complex mixture of proteins and/or macromolecules. Antibodies "bind to the same epitope" if the antibodies cross-compete (one prevents the binding or modulating effect of the other). In addition structural definitions of epitopes (overlapping, similar, identical) are informative, but functional definitions are often more relevant as they encompass structural (binding) and functional (modulation, competition) parameters.

The term "surface plasmon resonance", as used herein, refers to an optical phenomenon that allows for the analysis of real-time biospecific interactions by detection of alterations in protein concentrations within a biosensor matrix, for example using the BIAcore® system (BIAcore International AB, a GE Healthcare company, Uppsala, Sweden and Piscataway, N.J.). For further descriptions, see Jonsson et al. (1993) Ann. Biol. Clin. 51:19-26; Jonsson.

The term "$K_{on}$" refers to the on rate constant for association of a binding protein (e.g., an antibody) to the antigen to form the, e.g., antibody/antigen complex as is known in the art. The "Kon" also is known by the terms "association rate constant", or "ka", as used interchangeably herein. This value indicating the binding rate of an antibody to its target antigen or the rate of complex formation between an antibody and antigen also is shown by the equation below:

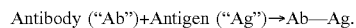

Antibody ("Ab")+Antigen ("Ag")→Ab—Ag.

The term "$K_{off}$" refers to the off rate constant for dissociation, or "dissociation rate constant", of a binding protein (e.g., an antibody) from the, e.g., antibody/antigen complex as is known in the art. The "$K_{off}$" also is known by the terms "dissociation rate constant" or "$k_d$" as used interchangeably herein. This value indicates the dissociation rate of an antibody from its target antigen or separation of Ab—Ag complex over time into free antibody and antigen as shown by the equation below:

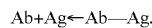

Ab+Ag←Ab—Ag.

The terms "$K_D$" and "equilibrium dissociation constant", and refers to the value obtained in a titration measurement at equilibrium, or by dividing the dissociation rate constant (koff) by the association rate constant (kon). The association rate constant, the dissociation rate constant and the equilibrium dissociation constant, are used to represent the binding affinity of an antibody to an antigen. Methods for determining association and dissociation rate constants are well known in the art. Using fluorescence-based techniques offers high sensitivity and the ability to examine samples in physiological buffers at equilibrium. Other experimental approaches and instruments such as a BIAcore® (biomolecular interaction analysis) assay, can be used (e.g., instrument available from BIAcore International AB, a GE Healthcare company, Uppsala, Sweden). Additionally, a KinExA® (Kinetic Exclusion Assay) assay, available from Sapidyne Instruments (Boise, Id.), can also be used.

The term "operably linked" refers to a juxtaposition wherein the components described are in a relationship permitting them to function in their intended manner. A control sequence "operably linked" to a coding sequence is ligated in such a way that expression of the coding sequence is achieved under conditions compatible with the control sequences. "Operably linked" sequences include both expression control sequences that are contiguous with the gene of interest and expression control sequences that act in trans or at a distance to control the gene of interest. The term "expression control sequence" as used herein refers to polynucleotide sequences which are useful to effect the expression and processing of coding sequences to which they are ligated. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (i.e., Kozak consensus sequence); sequences that enhance protein stability; and when desired, sequences that enhance protein secretion. The nature of such control sequences differs depending upon the host organism; in prokaryotes, such control sequences generally include promoter, ribosomal binding site, and transcription termination sequence; in eukaryotes, generally, such control sequences include promoters and transcription termination sequence. The term "control sequences" is intended to include components whose presence is essential for expression and processing, and can also include additional components whose presence is advantageous, for example, leader sequences and fusion partner sequences.

The term "recombinant host cell" (or simply "host cell"), is intended to refer to a cell into which exogenous DNA has been introduced. In an embodiment, the host cell comprises two more more (e.g., multiple) nucleic acids encoding antibodies, such as the host cells described in U.S. Pat. No. 7,262,028, for example. It should be understood that such terms are intended to refer not only to the particular subject cell, but to the progeny of such a cell. Because certain modifications may occur in succeeding generations due to either mutation or environmental influences, such progeny may not, in fact, be identical to the parent cell, but are still included within the scope of the term "host cell" as used herein. In an embodiment, host cells include prokaryotic and eukaryotic cells selected from any of the Kingdoms of life. In another embodiment, eukaryotic cells include protist, fungal, plant and animal cells. In another embodiment, host cells include but are not limited to the prokaryotic cell line *E. Coli*; mammalian cell lines CHO, HEK 293, COS, NS0, SP2 and PER.C6; the insect cell line Sf9; and the fungal cell *Saccharomyces cerevisiae*.

Standard techniques may be used for recombinant DNA, oligonucleotide synthesis, and tissue culture and transformation (e.g., electroporation, lipofection). Enzymatic reactions and purification techniques may be performed according to manufacturer's specifications or as commonly accomplished in the art or as described herein. The foregoing techniques and procedures may be generally performed according to conventional methods well known in the art and as described in various general and more specific references that are cited and discussed throughout the present specification. See e.g., Sambrook et al. MOLECULAR CLONING: A LABORATORY MANUAL (2d ed., Cold Spring Harbor Laboratory Press, Cold Spring Harbor, N.Y. (1989)), which is incorporated herein by reference for any purpose.

"Predetermined cutoff" and "predetermined level" refer generally to an assay cutoff value that is used to assess diagnostic/prognostic/therapeutic efficacy results by comparing the assay results against the predetermined cutoff/level, where the predetermined cutoff/level already has been linked or associated with various clinical parameters (e.g., severity of disease, progression/nonprogression/improvement, etc.). While the present disclosure may provide exemplary predetermined levels, it is well-known that cutoff values may vary depending on the nature of the immunoassay (e.g., antibodies employed, etc.). It further is well within the ordinary skill of one in the art to adapt the disclosure herein for other immunoassays to obtain immunoassay-specific cutoff values for those other immunoassays based on this disclosure. Whereas the precise value of the predetermined cutoff/level may vary between assays, correlations as described herein (if any) may be generally applicable.

"Pretreatment reagent," e.g., lysis, precipitation and/or solubilization reagent, as used in a diagnostic assay as described herein is one that lyses any cells and/or solubilizes any analyte that is/are present in a test sample. Pretreatment is not necessary for all samples, as described further herein. Among other things, solubilizing the analyte (e.g., polypeptide of interest) may entail release of the analyte from any endogenous binding proteins present in the sample. A pretreatment reagent may be homogeneous (not requiring a separation step) or heterogeneous (requiring a separation step). With use of a heterogeneous pretreatment reagent there is removal of any precipitated analyte binding proteins from the test sample prior to proceeding to the next step of the assay.

"Quality control reagents" in the context of immunoassays and kits described herein, include, but are not limited to, calibrators, controls, and sensitivity panels. A "calibrator" or "standard" typically is used (e.g., one or more, such as a plurality) in order to establish calibration (standard) curves for interpolation of the concentration of an analyte, such as an antibody or an analyte. Alternatively, a single calibrator, which is near a predetermined positive/negative cutoff, can be used. Multiple calibrators (i.e., more than one calibrator or a varying amount of calibrator(s)) can be used in conjunction so as to comprise a "sensitivity panel."

The terms "specific" and "specificity" in the context of an interaction between members of a specific binding pair (e.g., an antigen (or fragment thereof) and an antibody (or antigenically reactive fragment thereof)) refer to the selective reactivity of the interaction. The phrase "specifically binds to" and analogous phrases refer to the ability of antibodies (or antigenically reactive fragments thereof) to bind specifically to analyte (or a fragment thereof) and not bind specifically to other entities.

The term "specific binding partner" is a member of a specific binding pair. A specific binding pair comprises two different molecules, which specifically bind to each other through chemical or physical means. Therefore, in addition to antigen and antibody specific binding pairs of common immunoassays, other specific binding pairs can include biotin and avidin (or streptavidin), carbohydrates and lectins, complementary nucleotide sequences, effector and receptor molecules, cofactors and enzymes, enzyme inhibitors and enzymes, and the like. Furthermore, specific binding pairs can include members that are analogs of the original specific binding members, for example, an analyte-analog. Immunoreactive specific binding members include antigens, antigen fragments, and antibodies, including monoclonal and polyclonal antibodies as well as complexes, fragments, and variants (including fragments of variants) thereof, whether isolated or recombinantly produced.

The term "variant" means a polypeptide that differs from a given polypeptide in amino acid sequence by the addition (e.g., insertion), deletion, or conservative substitution of amino acids, but that retains the biological activity of the given polypeptide (e.g., a variant IL-17 can compete with anti-IL-17 antibody for binding to IL-17). A conservative substitution of an amino acid, i.e., replacing an amino acid with a different amino acid of similar properties (e.g., hydrophilicity and degree and distribution of charged regions) is recognized in the art as typically involving a minor change. These minor changes can be identified, in part, by considering the hydropathic index of amino acids, as understood in the art (see, e.g., Kyte et al. (1982) J. Mol. Biol. 157: 105-132). The hydropathic index of an amino acid is based on a consideration of its hydrophobicity and charge. It is known in the art that amino acids of similar hydropathic indexes can be substituted and still retain protein function. In one aspect, amino acids having hydropathic indexes of ±2 are substituted. The hydrophilicity of amino acids also can be used to reveal substitutions that would result in proteins retaining biological function. A consideration of the hydrophilicity of amino acids in the context of a peptide permits calculation of the greatest local average hydrophilicity of that peptide, a useful measure that has been reported to correlate well with antigenicity and immunogenicity (see, e.g., U.S. Pat. No. 4,554,101). Substitution of amino acids having similar hydrophilicity values can result in peptides retaining biological activity, for example immunogenicity, as is understood in the art. In one aspect, substitutions are performed with amino acids having hydrophilicity values within ±2 of each other. Both the hydrophobicity index and the hydrophilicity value of amino acids are influenced by the particular side chain of that amino acid. Consistent with that observation, amino acid substitutions that are compatible with biological function are understood to depend on the relative similarity of the amino acids, and particularly the side chains of those amino acids, as revealed by the hydrophobicity, hydrophilicity, charge, size, and other properties. "Variant" also can be used to describe a polypeptide or fragment thereof that has been differentially processed, such as by proteolysis, phosphorylation, or other post-translational modification, yet retains its biological activity or antigen reactivity, e.g., the ability to bind to IL-18. Use of "variant" herein is intended to encompass fragments of a variant unless otherwise contradicted by context.

I) Generation of DVD-Binding Protein

Dual Variable Domain binding proteins capable of binding TNF and methods of making the same are provided. The binding protein can be generated using various techniques. Expression vectors, host cell and methods of generating the binding protein are provided.

A) Construction of DVD-Binding Protein Molecules

The dual variable domain (DVD) binding protein molecule is designed such that two different light chain variable domains (VL) from the two different parent monoclonal antibodies are linked in tandem directly or via a short linker by recombinant DNA techniques, followed by the light chain constant domain. Similarly, the heavy chain comprises two different heavy chain variable domains (VH) linked in tandem, followed by the constant domain CH1 and Fc region (FIG. 1A).

The variable domains can be obtained using recombinant DNA techniques from a parent antibody generated by any one of the methods described herein. In an embodiment, the variable domain is a murine heavy or light chain variable domain. In another embodiment, the variable domain is a CDR grafted or a humanized variable heavy or light chain domain. In an embodiment, the variable domain is a human heavy or light chain variable domain.

In one embodiment the first and second variable domains are linked directly to each other using recombinant DNA techniques. In another embodiment the variable domains are linked via a linker sequence. In an embodiment, two variable domains are linked. Three or more variable domains may also be linked directly or via a linker sequence. The variable domains may bind the same antigen or may bind different antigens. In some embodiments, the DVD-binding protein molecules may include one immunoglobulin variable domain and one non-immunoglobulin variable domain such as ligand binding domain of a receptor, active domain of an enzyme. DVD-binding protein molecules may also comprise 2 or more non-Ig domains.

The linker sequence may be a single amino acid or a polypeptide sequence. In an embodiment, the linker sequences are AKTTPKLEEGEFSEAR (SEQ ID NO: 1); AKTTPKLEEGEFSEARV (SEQ ID NO: 2); AKTTPKLGG (SEQ ID NO: 3); SAKTTPKLGG (SEQ ID NO: 4); SAKTTP (SEQ ID NO: 5); RADAAP (SEQ ID NO: 6); RADAAPTVS (SEQ ID NO: 7); RADAAAAGGPGS (SEQ ID NO: 8); RADAAAA(G$_4$S)$_4$ (SEQ ID NO: 9), SAKTTPKLEEGEFSEARV (SEQ ID NO: 10); ADAAP (SEQ ID NO: 11); ADAAPTVSIFPP (SEQ ID NO: 12); TVAAP (SEQ ID NO: 13); TVAAPSVFIFPP (SEQ ID NO: 14); QPKAAP (SEQ ID NO: 15); QPKAAPSVTLFPP (SEQ ID NO: 16); AKTTPP (SEQ ID NO: 17); AKTTPPSVTPLAP (SEQ ID NO: 18); AKTTAP (SEQ ID NO: 19); AKTTAPSVYPLAP (SEQ ID NO: 20); ASTKGP (SEQ ID NO: 21); ASTKGPSVFPLAP (SEQ ID NO: 22), GGGGSGGGGSGGGGS (SEQ ID NO: 23); GENKVEYAPALMALS (SEQ ID NO: 24); GPAKELTPLKEAKVS (SEQ ID NO: 25); GHEAAAVMQVQYPAS (SEQ ID NO: 26); TVAAPSVFIFPPTVAAPSVFIFPP (SEQ ID NO: 27); and ASTKGPSVFPLAPASTKGPSVFPLAP (SEQ ID NO: 28). The choice of linker sequences is based on crystal structure analysis of several Fab molecules. There is a natural flexible linkage between the variable domain and the CH1/CL constant domain in Fab or antibody molecular structure. This natural linkage comprises approximately 10-12 amino acid residues, contributed by 4-6 residues from C-terminus of V domain and 4-6 residues from the N-terminus of CL/CH1 domain. DVD-binding protein Igs were generated using N-terminal 5-6 amino acid residues, or 11-12 amino acid residues, of CL or CH1 as linker in light chain and heavy chain of DVD-binding protein, respectively. The N-terminal residues of CL or CH1 domains, particularly the first 5-6 amino acid residues, adopt a loop conformation without strong secondary structures, therefore can act as flexible linkers between the two variable domains. The N-terminal residues of CL or CH1 domains are natural extension of the variable domains, as they are part of the Ig sequences, therefore minimize to a large extent any immunogenicity potentially arising from the linkers and junctions.

Other linker sequences may include any sequence of any length of CL/CH1 domain but not all residues of CL/CH1 domain; for example the first 5-12 amino acid residues of the CL/CH1 domains; the light chain linkers can be from Cκ or Cλ; and the heavy chain linkers can be derived from CH1 of any isotypes, including Cγ1, Cγ2, Cγ3, Cγ4, Cα1, Cα2, Cδ, Cε, and Cμ. Linker sequences may also be derived from other proteins such as Ig-like proteins, (e.g., TCR, FcR, KIR); G/S based sequences (e.g., G4S repeats; SEQ ID NO: 29); hinge region-derived sequences; and other natural sequences from other proteins.

In an embodiment a constant domain is linked to the two linked variable domains using recombinant DNA techniques. In an embodiment, sequence comprising linked heavy chain variable domains is linked to a heavy chain constant domain and sequence comprising linked light chain variable domains is linked to a light chain constant domain. In an embodiment, the constant domains are human heavy chain constant domain and human light chain constant domain respectively. In an embodiment, the DVD heavy chain is further linked to an Fc region. The Fc region may be a native sequence Fc region, or a variant Fc region. In another embodiment, the Fc region is a human Fc region. In another embodiment the Fc region includes Fc region from IgG1, IgG2, IgG3, IgG4, IgA, IgM, IgE, or IgD.

In another embodiment two heavy chain DVD polypeptides and two light chain DVD polypeptides are combined to form a DVD-binding protein molecule. Table 1 lists amino acid sequences of VH and VL regions of exemplary antibodies for targets useful for treating disease, e.g., for treating cancer. In an embodiment, a DVD comprising at least two of the VH and/or VL regions listed in Table 1, in any orientation is provided. In some embodiments, VD1 and VD2 are independently chosen. Therefore, in some embodiments, VD1 and VD2 comprise the same SEQ ID NO and, in other embodiments, VD1 and VD2 comprise different SEQ ID NOS. The VH and VL domain sequences provided below comprise complementary determining region (CDR) and framework sequences that are either known in the art or readily discernable using methods known in the art. In some embodiments, one or more of these CDR and/or framework sequences are replaced, without loss of function, by other CDR and/or framework sequences from binding proteins that are known in the art to bind to the same antigen.

Table 1: List of Amino Acid Sequences of VH and VL Regions of Antibodies for Generating DVD-Binding Proteins Three different anti-IL-17 variants are shown in Table 1A (seq. 1, seq. 2, and seq. 3)

TABLE 1A

Certain VH and VL Regions that Bind IL-17

| SEQ ID No. | ABT Unique ID | Protein region | Sequence 1234567890123456789012345678901234567890 |
|---|---|---|---|
| 30 | AB273VH | VH-IL17 (seq. 1) | EVQLVQSGAEVKKPGSSVKVSCKASGYTFTDYEIHWVRQA PGQGLEWMGVNDPESGGTFYNQKFDGRVTLTADESTSTAY MELSSLRSEDTAVYYCTRYSKWDSFDGMDYWGQGTTVTVS S |
| 31 | AB273VL | VL-IL17 (seq. 1) | DIQMTQSPSSLSASVGDRVTITCRASSGIISYIDWFQQKP GKAPKRLIYATFDLASGVPSRFSGSGSGTDYTLTISSLQP EDFATYYCRQVGSYPETFGQGTKLEIKR |
| 32 | AB274VH | VH-IL17 (seq. 2) | EVQLVQSGAEVKKPGSSVKVSCKASGGSFGGYGIGWVRQA PGQGLEWMGGITPFFGFADYAQKFQGRVTITADESTTTAY MELSGLTSDDTAVYYCARDPNEFWNGYYSTHDFDSWGQGT TVTVSS |
| 33 | AB274VL | VL-IL17 (seq. 2) | EIVLTQSPDFQSVTPKEKVTITCRASQDIGSELHWYQQKP DQPPKLLIKYASHSTSGVPSRFSGSGSGTDFTLTINGLEA EDAGTYYCHQTDSLPYTFGPGTKVDIKR |
| 34 | AB275VH | VH-IL17 (seq. 3) | EVQLVQSGAEVKKPGESVKISCKASGGSFRSYGISWVRQA PGQGLEWMGGITHFFGITDYAQKFQGRVTITADESTTTAY MELSGLTSDDTAVYYCAREPNDFWNGYYDTHDFDSWGQGT TVTVSS |
| 35 | AB275VL | VL-IL17 (seq. 3) | EIVLTQSPDFQSVTPKEKVTITCRASQNIGSELHWYQQKP DQSPKLLIKYASHSISGVPSRFSGSGSGTDFTLTINGLEA EDAATYYCHQSDTLPHTFGQGTKVDIKR |

Tables 1B and 1C provide the VH and VL sequences of fully human anti-human TNF monoclonal antibodies isolated by in vitro display technologies from human antibody libraries by their ability to bind recombinant human TNF proteins.

TABLE 1B

Individual Fully Human Anti-TNF-α VH Sequences

| Protein region | SEQ ID NO | Sequence 1234567890123456789012345678901234567890 |
|---|---|---|
| AE11-1 VH | SEQ ID NO.: 36 | EVQLVQSGAEVKKPGASVKVSCKASGYTFT SYDVNWVRQATGQGLEWMGWMNPNSGNTGY AQKFQGRVTITADESTSTAYMELSSLRSED TAVYYCAIFDSDYMDVWGKGTLVTVSS |

TABLE 1B-continued

Individual Fully Human Anti-TNF-α VH Sequences

| Protein region | | SEQ ID NO | Sequence<br>12345678901234567890123456789 0 |
|---|---|---|---|
| AE11-1 VH | CDR-H1 | Residues 31-35 of SEQ ID NO.: 36 | SYDVN |
| AE11-1 VH | CDR-H2 | Residues 50-66 of SEQ ID NO.: 36 | WMNPNSGNTGYAQKFQG |
| AE11-1 VH | CDR-H3 | Residues 99-106 of SEQ ID NO.: 36 | FDSDYMDV |
| AE11-5 VH | | SEQ ID NO.: 37 | EVQLVQSGAEVKKPGSSAKVSCKASGGTFS<br>SYAISWVRQAPGQGLEWMGGIIPILGTANY<br>AQKFLGRVTITADESTSTVYMELSSLRSED<br>TAVYYCARGLYYDPTRADYWGQGTLVTVSS |
| AE11-5 VH | CDR-H1 | Residues 31-35 of SEQ ID NO.: 37 | SYAIS |
| AE11-5 VH | CDR-H2 | Residues 50-66 of SEQ ID NO.: 37 | GIIPILGTANYAQKFLG |
| AE11-5 VH | CDR-H3 | Residues 99-109 of SEQ ID NO.: 37 | GLYYDPTRADY |
| TNF-JK1 VH | | SEQ ID NO.: 38 | EVQLVESGGGLVQPGGSLRLSCATSGFTFN<br>NYWMSWVRQAPGKGLEWVANINHDESEKYY<br>VDSAKGRFTISRDNAEKSLFLQMNSLRAED<br>TAVYYCARIIRGRVGFDYYNYAMDVWGQGT<br>LVTVSS |
| TNF-JK1 VH | CDR-H1 | Residues 31-35 of SEQ ID NO.: 38 | NYWMS |
| TNF-JK1 VH | CDR-H2 | Residues 50-66 of SEQ ID NO.: 38 | NINHDESEKYYVDSAKG |
| TNF-JK1 VH | CDR-H3 | Residues 99-115 of SEQ ID NO.: 38 | IIRGRVGFDYYNYAMDV |
| TNF-JK1 VL | CDR-L3 | Residues 89-95 of SEQ ID NO.: 44 | QESYSLI |
| TNF-Y7C VH | | SEQ ID NO.: 39 | EVQLVQSGAEVKKPGASVKVSCKTSGYTFS<br>NYDINWVRQPTGQGLEWMGWMDPNNGNTGY<br>AQKFVGRVTMTRDTSKTTAYLELSGLKSED<br>TAVYYCARSSGSGGTWYKEYFQSWGQGTMV<br>TVSS |
| TNF-Y7C VH | CDR-H1 | Residues 31-35 of SEQ ID NO.: 39 | NYDIN |
| TNF-Y7C VH | CDR-H2 | Residues 50-66 of SEQ ID NO.: 39 | WMDPNNGNTGYAQKFVG |
| TNF-Y7C VH | CDR-H3 | Residues 99-112 of SEQ ID NO.: 39 | KSSGSGGTWYKEYFQS |
| AE11-7 VH | | SEQ ID NO.: 40 | EVQLVQSGAEVKKPGASVKVSCKTSGYSLT<br>QYPIHWVRQAPGQRPEWMGWISPGNGNTKL<br>SPKFQGRVTLSRDASAGTVFMDLSGLTSDD<br>TAVYFCTSVDLGDHWGQGTLVTVSS |

TABLE 1B-continued

Individual Fully Human Anti-TNF-α VH Sequences

| Protein region | | SEQ ID NO | Sequence<br>12345678901234567890123456789 0 |
|---|---|---|---|
| AE11-7 VH | CDR-H1 | Residues 31-35 of SEQ ID NO.: 40 | QYPIH |
| AE11-7 VH | CDR-H2 | Residues 50-66 of SEQ ID NO.: 40 | WISPGNGNTKLSPKFQG |
| AE11-7 VH | CDR-H3 | Residues 99-104 of SEQ ID NO.: 40 | VDLGDH |
| AE11-13 VH | | SEQ ID NO.: 41 | EVQLVESGGGLVQPGRSLRLSCAASGFTFDDYPMHWVRQAPGEGLEWVSGISSNSASIGYADSVKGRFTISRDNAQNTLYLQMNSLGDEDTAVYYCVSLTLGIGQGTLVTVSS |
| AE11-13 VH | CDR-H1 | Residues 31-35 of SEQ ID NO.: 41 | DYPMH |
| AE11-13 VH | CDR-H2 | Residues 50-66 of SEQ ID NO.: 41 | GISSNSASIGYADSVKG |
| AE11-13 VH | CDR-H3 | Residues 99-102 of SEQ ID NO.: 41 | LTLG |

TABLE 1C

Individual Fully Human anti-TNF-α VL Sequences

| Protein region | SEQ ID NO. | Sequence<br>12345678901234567890123456789 0 |
|---|---|---|
| AE11-1 VL | SEQ ID NO.: 42 | SYELTQPPSVSLSPGQTARITCSGDALPKQYAYWYQQKPGQAPVLVIYKDTERPSGIPERFSGSSSGTTVTLTISGAQAEDEADYYCQSADSSGTSWVFGGGTKLTVL |
| AE11-1 VL CDR-L1 | Residues 23-33 of SEQ ID NO.: 42 | SGDALPKQYAY |
| AE11-1 VL CDR-L2 | Residues 49-55 of SEQ ID NO.: 42 | KDTERPS |
| AE11-1 VL CDR-L3 | Residues 89-98 of SEQ ID NO.: 42 | SADSSGTSWV |
| AE11-5 VL | SEQ ID NO.: 43 | DIVMTQSPDFHSVTPKEKVTITCRASQSIGSSLHWYQQKPDQSPKLLIRHASQSISGVPSRFSGSGSGTDFTLTIHSLEAEDAATYYCHQSSSSPPPTFGQGTQVEIK |
| AE11-5 VL CDR-L1 | Residues 24-34 of SEQ ID NO.: 43 | RASQSIGSSLH |
| AE11-5 VL CDR-L2 | Residues 50-56 of SEQ ID NO.: 43 | HASQSIS |
| AE11-5 VL CDR-L3 | Residues 89-98 of SEQ ID NO.: 43 | HQSSSSPPPT |

TABLE 1C-continued

Individual Fully Human anti-TNF-α VL Sequences

| Protein region | SEQ ID NO. | Sequence 12345678901234567890123456789 0 |
|---|---|---|
| TNF-JK1 VL | SEQ ID NO.: 44 | DIRLTQSPSPLSASVGDRVTITCRASQSIG NYLNWYQHKPGKAPKLLIYAASSLQSGVPS RFSGTGSGTDFTLTISSLQPEDFATYYCQE SYSLIFAGGTKVEIK |
| INF-JK1 VLCDR-L1 | Residues 24-34 of SEQ ID NO.: 44 | RASQSIGNYLN |
| INF-JK1 VLCDR-L2 | Residues 50-56 of SEQ ID NO.: 44 | AASSLQS |
| TNF-JK1 VLCDR-L3 | Residues 89-95 of SEQ ID NO.: 44 | QESYSLI |
| TNF-Y7C VL | SEQ ID NO.: 45 | DIVMTQSPLSLPVTPGEPASISCRSSQSLL HSNGYNYLDWYLQKPGQFPQLLIYLGSYRA SGVPDRFSGSGSGTDFTLKISRVEAEDVGV YYCMQRIEFPPGTFGQGTELGIK |
| TNF-Y7C VLCDR-L1 | Residues 24-39 of SEQ ID NO.: 45 | RSSQSLLHSNGYNYLD |
| TNF-Y7C VLCDR-L2 | Residues 55-61 of SEQ ID NO.: 45 | LGSYRAS |
| TNF-Y7C VLCDR-L3 | Residues 94-103 of SEQ ID NO.: 45 | MQRIEFPPGT |
| AE11-7 VL | SEQ ID NO.: 46 | DIVMTQSPEFQSVTPKEKVTITCRASQSIG SSLHWYQQKPDQSPKLLINYASQSFSGVPS RFSGGGSGTDFTLTINSLEAEDAATYYCHQ SSNLPITFGQGTRLEIK |
| AE11-7 VL CDR-L1 | Residues 24-34 of SEQ ID NO.: 46 | RASQSIGSSLH |
| AE11-7 VL CDR-L2 | Residues 50-56 of SEQ ID NO.: 46 | YASQSFS |
| AE11-7 VL CDR-L3 | Residues 89-97 of SEQ ID NO.: 46 | HQSSNLPIT |
| AE11-13 VL | SEQ ID NO.: 47 | DIRLTQSPSSLSASVGDRVTITCRASQSIG NYLHWYQQKPGKAPKLLIYAASSLQSGVPS RFSGSGSGTDFTLTISSLQPEDFATYYCQQ SYSTLYSFGQGTKLEIK |
| AE11-13 VLCDR-L1 | Residues 24-34 of SEQ ID NO.: 47 | RASQSIGNYLH |
| AE11-13 VLCDR-L2 | Residues 50-56 of SEQ ID NO.: 47 | AASSLQS |
| AE11-13 VLCDR-L3 | Residues 89-97 of SEQ ID NO.: 47 | QQSYSTLYS |

Tables 1D and 1E below provide a list of humanized ant-TNF MAK-195 antibodies that were converted into IgG proteins for characterization, both VH and VL sequences.

TABLE 1D

Humanized Anti-TNF MAK-195 Ab VH sequences of IgG converted clones

| | Protein region | | Sequence<br>12345678901234567890123456789 0 |
|---|---|---|---|
| A8 VH | | SEQ ID NO.: 48 | EVQLVESGGGLVQPGGSLRLSCAASGFTFS<br>NYGVNWVRQAPGKGLEWVSMIAADGFTDYA<br>SSVKGRFTISRDNSKNTLYLQMNSLRAEDT<br>AVYYCAREWHHGPVAYWGQGTLVTVSS |
| A8 VH | CDR-H1 | Residues 31-35 of SEQ ID NO.: 48 | NYGVN |
| A8 VH | CDR-H2 | Residues 50-65 of SEQ ID NO.: 48 | MIAADGFTDYASSVKG |
| A8 VH | CDR-H3 | Residues 98-106 of SEQ ID NO.: 48 | EWHHGPVAY |
| B5 VH | | SEQ ID NO.: 49 | EVQLVESGGGLVQPGGSLRLSCAASGFTFS<br>NYGVSWVRQAPGKGLEWVSLIRGDGSTDYA<br>SSLKGRFTISRDNSKNTLYLQMNSLRAEDT<br>AVYYCAREWHHGPVAYWGQGTLVTVSS |
| B5 VH | CDR-H1 | Residues 31-35 of SEQ ID NO.: 49 | NYGVS |
| B5 VH | CDR-H2 | Residues 50-65 of SEQ ID NO.: 49 | LIRGDGSTDYASSLKG |
| B5 VH | CDR-H3 | Residues 98-106 of SEQ ID NO.: 49 | EWHHGPVAY |
| rHC44 VH | | SEQ ID NO.: 50 | EVQLVESGGGLVQPGGSLRLSCAASGFTFS<br>NYGVSWVRQAPGKGLEWVSMIWADGSTHYA<br>DTLKSRFTISRDNSKNTLYLQMNSLRAEDT<br>AVYYCAREWQHGPVAYWGQGTLVTVSS |
| rHC44 VH | CDR-H1 | Residues 31-35 of SEQ ID NO.: 50 | NYGVS |
| rHC44 VH | CDR-H2 | Residues 50-65 of SEQ ID NO.: 50 | MIWADGSTHYADTLKS |
| rHC44 VH | CDR-H3 | Residues 98-106 of SEQ ID NO.: 50 | EWQHGPVAY |
| rHC22 VH | | SEQ ID NO.: 51 | EVQLVESGGGLVQPGGSLRLSCAASGFTFS<br>NYGVTWVRQAPGKGLEWVSMIWADGSTDYA<br>DTVKGRFTISRDNSKNTLYLQMNSLRAEDT<br>AVYYCAREWQHGPVAYWGQGTLVTVSS |
| rHC22 VH | CDR-H1 | Residues 31-35 of SEQ ID NO.: 51 | NYGVT |
| rHC22 VH | CDR-H2 | Residues 50-65 of SEQ ID NO.: 51 | MIWADGSTDYADTVKG |
| rHC22 VH | CDR-H3 | Residues 98-106 of SEQ ID NO.: 51 | EWQHGPVAY |
| rHC81 VH | | SEQ ID NO.: 52 | EVQLVESGGGLVQPGGSLRLSCAASGFTFS<br>NYGVTWVRQAPGKGLEWVSMIWADGSTHYA<br>DSVKSRFTISRDNSKNTLYLQMNSLRAEDT<br>AVYYCAREWQHGPLAYWGQGTLVTVSS |
| rHC81 VH | CDR-H1 | Residues 31-35 of SEQ ID NO.: 52 | NYGVT |
| rHC81 VH | CDR-H2 | Residues 50-65 of SEQ ID NO.: 52 | MIWADGSTHYADSVKS |
| rHC81 VH | CDR-H3 | Residues 98-106 of SEQ ID NO.: 52 | EWQHGPLAY |
| rHC18 VH | | SEQ ID NO.: 53 | EVQLVESGGGLVQPGGSLRLSCAASGFTFS<br>NYGVTWVRQAPGKGLEWVSMIWSDGSTDYA<br>SSVKGRFTISRDNSKNTLYLQMNSLRAEDT<br>AVYYCAREWQHGPVAYWGQGTLVTVSS |

TABLE 1D-continued

Humanized Anti-TNF MAK-195 Ab VH sequences of IgG converted clones

| | Protein region | | Sequence 12345678901234567890123456789 0 |
|---|---|---|---|
| rHC18 VH | CDR-H1 | Residues 31-35 of SEQ ID NO.: 53 | NYGVT |
| rHC18 VH | CDR-H2 | Residues 50-65 of SEQ ID NO.: 53 | MIWSDGSTDYASSVKG |
| rHC18 VH | CDR-H3 | Residues 98-106 of SEQ ID NO.: 53 | EWQHGPVAY |
| rHC14 VH | | SEQ ID NO.: 54 | EVQLVESGGGLVQPGGSLRLSCAASGFTFSNYGVTWVRQAPGKGLEWVSMIWADGSTHYASSLKGRFTISRDNSKNTLYLQMNSLRAEDTAVYYCAREWQHGPAAYWGQGTLVTVSS |
| rHC14 VH | CDR-H1 | Residues 31-35 of SEQ ID NO.: 54 | NYGVT |
| rHC14 VH | CDR-H2 | Residues 50-65 of SEQ ID NO.: 54 | MIWADGSTHYASSLKG |
| rHC14 VH | CDR-H3 | Residues 98-106 of SEQ ID NO.: 54 | EWQHGPAAY |
| rHC3 VH | | SEQ ID NO.: 55 | EVQLVESGGGLVQPGGSLRLSCAASGFTFSNYGVSWVRQAPGKGLEWVSMIWADGSTHYASSLKGRFTISRDNSKNTLYLQMNSLRAEDTAVYYCAREWQHGPVAYWGQGTLVTVSS |
| rHC3 VH | CDR-H1 | Residues 31-35 of SEQ ID NO.: 55 | NYGVS |
| rHC3 VH | CDR-H2 | Residues 50-65 of SEQ ID NO.: 55 | MIWADGSTHYASSLKG |
| rHC3 VH | CDR-H3 | Residues 98-106 of SEQ ID NO.: 55 | EWQHGPVAY |
| rHC19 VH | | SEQ ID NO.: 56 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPAAYWGQGTLVTVSS |
| rHC19 VH | CDR-H1 | Residues 31-35 of SEQ ID NO.: 56 | NYGVT |
| rHC19 VH | CDR-H2 | Residues 50-65 of SEQ ID NO.: 56 | MIWADGSTHYASSVKG |
| rHC19 VH | CDR-H3 | Residues 98-106 of SEQ ID NO.: 56 | EWQHGPAAY |
| rHC34 VH | | SEQ ID NO.: 57 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPSAYWGQGTLVTVSS |
| rHC34 VH | CDR-H1 | Residues 31-35 of SEQ ID NO.: 57 | NYGVT |
| rHC34 VH | CDR-H2 | Residues 50-65 of SEQ ID NO.: 57 | MIWADGSTHYASSVKG |
| rHC34 VH | CDR-H3 | Residues 98-106 of SEQ ID NO.: 57 | EWQHGPSAY |
| rHC83 VH | | SEQ ID NO.: 58 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| rHC83 VH | CDR-H1 | Residues 31-35 of SEQ ID NO.: 58 | NYGVT |

TABLE 1D-continued

Humanized Anti-TNF MAK-195 Ab VH sequences of IgG converted clones

| | Protein region | | Sequence 123456789012345678901234567890 |
|---|---|---|---|
| rHC83 VH | CDR-H2 | Residues 50-65 of SEQ ID NO.: 58 | MIWADGSTHYASSVKG |
| rHC83 VH | CDR-H3 | Residues 98-106 of SEQ ID NO.: 58 | EWQHGPVAY |
| S4-19 VH | | SEQ ID NO.: 59 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS |
| S4-19 VH | CDR-H1 | Residues 31-35 of SEQ ID NO.: 59 | NYGVE |
| S4-19 VH | CDR-H2 | Residues 50-65 of SEQ ID NO.: 59 | GIWADGSTHYADTVKS |
| S4-19 VH | CDR-H3 | Residues 98-106 of SEQ ID NO.: 59 | EWQHGPVAY |
| S4-50 VH | | SEQ ID NO.: 60 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVGYWGQGTLVTVSS |
| S4-50 VH | CDR-H1 | Residues 31-35 of SEQ ID NO.: 60 | NYGVE |
| S4-50 VH | CDR-H2 | Residues 50-65 of SEQ ID NO.: 60 | GIWADGSTHYADTVKS |
| S4-50 VH | CDR-H3 | Residues 98-106 of SEQ ID NO.: 60 | EWQHGPVGY |
| S4-63 VH | | SEQ ID NO.: 61 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVGYWGQGTLVTVSS |
| S4-63 VH | CDR-H1 | Residues 31-35 of SEQ ID NO.: 61 | NYGVE |
| S4-63 VH | CDR-H2 | Residues 50-65 of SEQ ID NO.: 61 | GIWADGSTHYADTVKS |
| S4-63 VH | CDR-H3 | Residues 98-106 of SEQ ID NO.: 61 | EWQHGPVGY |
| S4-55 VH | | SEQ ID NO.: 62 | EVQLVESGGGLVQPGGSLRLSCAASGFTFSNYGVTWVRQAPGKGLEWVSMIWADGSTDYASTVKGRFTISRDNSKNTLYLQMNSLRAEDTAVYYCAREWQHGPVGYWGQGTLVTVSS |
| S4-55 VH | CDR-H1 | Residues 31-35 of SEQ ID NO.: 62 | NYGVT |
| S4-55 VH | CDR-H2 | Residues 50-65 of SEQ ID NO.: 62 | MIWADGSTDYASTVKG |
| S4-55 VH | CDR-H3 | Residues 98-106 of SEQ ID NO.: 62 | EWQHGPVGY |
| S4-6 VH | | SEQ ID NO.: 63 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-6 VH | CDR-H1 | Residues 31-35 of SEQ ID NO.: 63 | NYGVT |
| S4-6 VH | CDR-H2 | Residues 50-65 of SEQ ID NO.: 63 | MIWADGSTHYASSVKG |

TABLE 1D-continued

Humanized Anti-TNF MAK-195 Ab VH sequences of IgG converted clones

| | Protein region | | Sequence<br>12345678901234567890123456789 0 |
|---|---|---|---|
| S4-6 VH | CDR-H3 | Residues 98-106 of SEQ ID NO.: 63 | EWQHGPVAY |
| S4-18 VH | | SEQ ID NO.: 64 | EVQLVESGGGLVQPGGSLRLSCAASGFTFSNYGVTWVRQAPGKGLEWVSMIWADGSTHYADSVKSRFTISRDNSKNTLYLQMNSLRAEDTAVYYCAREWQHGPLAYWGQGTLVTVSS |
| S4-18 VH | CDR-H1 | Residues 31-35 of SEQ ID NO.: 64 | NYGVT |
| S4-18 VH | CDR-H2 | Residues 50-65 of SEQ ID NO.: 64 | MIWADGSTHYADSVKS |
| S4-18 VH | CDR-H3 | Residues 98-106 of SEQ ID NO.: 64 | EWQHGPLAY |
| S4-31 VH | | SEQ ID NO.: 65 | EVQLVESGGGLVQPGGSLRLSCAASGFTFSNYGVQWVRQAPGKGLEWVSGIGADGSTAYASSLKGRFTISRDNSKNTLYLQMNSLRAEDTAVYYCAREWQHSGLAYWGQGTLVTVSS |
| S4-31 VH | CDR-H1 | Residues 31-35 of SEQ ID NO.: 65 | NYGVQ |
| S4-31 VH | CDR-H2 | Residues 50-65 of SEQ ID NO.: 65 | GIGADGSTAYASSLKG |
| S4-31 VH | CDR-H3 | Residues 98-106 of SEQ ID NO.: 65 | EWQHSGLAY |
| S4-34 VH | | SEQ ID NO.: 66 | EVQLVESGGGLVQPGGSLRLSCAASGFTFSNYGVSWVRQAPGKGLEWVSMIWADGSTHYADTVKGRFTISRDNSKNTLYLQMNSLRAEDTAVYYCAREWQHGPLAYWGQGTLVTVSS |
| S4-34 VH | CDR-H1 | Residues 31-35 of SEQ ID NO.: 66 | NYGVS |
| S4-34 VH | CDR-H2 | Residues 50-65 of SEQ ID NO.: 66 | MIWADGSTHYADTVKG |
| S4-34 VH | CDR-H3 | Residues 98-106 of SEQ ID NO.: 66 | EWQHGPLAY |
| S4-74 VH | | SEQ ID NO.: 67 | EVQLVESGGGLVQPGGSLRLSCAASGFTFSNYGVTWVRQAPGKGLEWVSMIWADGSTHYADTVKGRFTISRDNSKNTLYLQMNSLRAEDTAVYYCAREWQHGPLAYWGQGTLVTVSS |
| S4-74 VH | CDR-H1 | Residues 31-35 of SEQ ID NO.: 67 | NYGVT |
| S4-74 VH | CDR-H2 | Residues 50-65 of SEQ ID NO.: 67 | MIWADGSTHYADTVKG |
| S4-74 VH | CDR-H3 | Residues 98-106 of SEQ ID NO.: 67 | EWQHGPLAY |
| S4-12 VH | | SEQ ID NO.: 68 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| S4-12 VH | CDR-H1 | Residues 31-35 of SEQ ID NO.: 68 | NYGVT |
| S4-12 VH | CDR-H2 | Residues 50-65 of SEQ ID NO.: 68 | MIWADGSTHYASSVKG |
| S4-12 VH | CDR-H3 | Residues 98-106 of SEQ ID NO.: 68 | EWQHGPVAY |

TABLE 1D-continued

Humanized Anti-TNF MAK-195 Ab VH sequences of IgG converted clones

| Protein region | | | Sequence 12345678901234567890123456 7890 |
|---|---|---|---|
| S4-54 VH | | SEQ ID NO.: 69 | EVQLVESGGGLVQPGGSLRLSCAASGFTFS NYGVTWVRQAPGKGLEWVSMIWADGSTHYA SSVKGRFTISRDNSKNTLYLQMNSLRAEDT AVYYCAREWQHGPVAYWGQGTLVTVSS |
| S4-54 VH | CDR-H1 | Residues 31-35 of SEQ ID NO.: 69 | NYGVT |
| S4-54 VH | CDR-H2 | Residues 50-65 of SEQ ID NO.: 69 | MIWADGSTHYASSVKG |
| S4-54 VH | CDR-H3 | Residues 98-106 of SEQ ID NO.: 69 | EWQHGPVAY |
| S4-17 VH | | SEQ ID NO.: 70 | EVQLVESGGGLVQPGGSLRLSCAASGFTFS NYGVTWVRQAPGKGLEWVSMIWADGSTHYA SSVKGRFTISRDNSKNTLYLQMNSLRAEDT AVYYCAREWQHGPVAYWGQGTLVTVSS |
| S4-17 VH | CDR-H1 | Residues 31-35 of SEQ ID NO.: 70 | NYGVT |
| S4-17 VH | CDR-H2 | Residues 50-65 of SEQ ID NO.: 70 | MIWADGSTHYASSVKG |
| S4-17 VH | CDR-H3 | Residues 98-106 of SEQ ID NO.: 70 | EWQHGPVAY |
| S4-40 VH | | SEQ ID NO.: 71 | EVQLVESGGGLVQPGGSLRLSCAASGFTFS NYGVTWVRQAPGKGLEWVSMIWADGSTHYA SSVKGRFTISRDNSKNTLYLQMNSLRAEDT AVYYCAREWQHGPVAYWGQGTLVTVSS |
| S4-40 VH | CDR-H1 | Residues 31-35 of SEQ ID NO.: 71 | NYGVT |
| S4-40 VH | CDR-H2 | Residues 50-65 of SEQ ID NO.: 71 | MIWADGSTHYASSVKG |
| S4-40 VH | CDR-H3 | Residues 98-106 of SEQ ID NO.: 71 | EWQHGPVAY |
| S4-24 VH | | SEQ ID NO.: 72 | EVQLVESGGGLVQPGGSLRLSCAASGFTFS NYGVTWVRQAPGKGLEWVSMIWADGSTHYA SSVKGRFTISRDNSKNTLYLQMNSLRAEDT AVYYCAREWQHGPVAYWGQGTLVTVSS |
| S4-24 VH | CDR-H1 | Residues 31-35 of SEQ ID NO.: 72 | NYGVT |
| S4-24 VH | CDR-H2 | Residues 50-65 of SEQ ID NO.: 72 | MIWADGSTHYASSVKG |
| S4-24 VH | CDR-H3 | Residues 98-106 of SEQ ID NO.: 72 | EWQHGPVAY |

TABLE 1E

Humanized Anti-TNF MAK-195 Ab VL sequences of IgG converted clones

| Protein region | SEQ ID NO. | Sequence 12345678901234567890123456 7890 |
|---|---|---|
| hMAK195 VL.1 VL | SEQ ID NO.: 73 | DIQMTQSPSSLSASVGDRVTITCKASQAVS SAVAWYQQKPGKAPKLLIYWASTRHTGVPS RFSGSGSGTDFTLTISSLQPEDFATYYCQQ HYSTPFTFGQGTKLEIKR |
| hMAK195 VL.1 VL | CDR-L1 | Residues 24-34 of SEQ ID NO.: 73 | KASQAVSSAVA |

TABLE 1E-continued

Humanized Anti-TNF MAK-195 Ab VL sequences of IgG converted clones

| Protein | region | SEQ ID NO. | Sequence<br>12345678901234567890 |
|---|---|---|---|
| hMAK195 VL.1 VL | CDR-L2 | Residues 50-56 of SEQ ID NO.: 73 | WASTRHT |
| hMAK195 VL.1 VL | CDR-L3 | Residues 89-97 of SEQ ID NO.: 73 | QQHYSTPFT |
| S4-24 VL | | SEQ ID NO.: 74 | DIQMTQSPSSLSASVGDRVTITCRASQLVS SAVAWYQQKPGKAPKLLIYWASTLHTGVPS RFSGSGSGTDFTLTISSLQPEDFATYYCQQ HYRTPFTFGQGTKLEIKR |
| S4-24 VL | CDR-L1 | Residues 24-34 of SEQ ID NO.: 74 | RASQLVSSAVA |
| S4-24 VL | CDR-L2 | Residues 50-56 of SEQ ID NO.: 74 | WASTLHT |
| S4-24 VL | CDR-L3 | Residues 89-97 of SEQ ID NO.: 74 | QQHYRTPFT |
| S4-40 VL | | SEQ ID NO.: 75 | DIQMTQSPSSLSASVGDRVTITCRASQLVS SAVAWYQQKPGKAPKLLIYWASTRHSGVPS RFSGSGSGTDFTLTISSLQPEDFATYYCQQ HYRTPFSFGQGTKLEIKR |
| S4-40 VL | CDR-L1 | Residues 24-34 of SEQ ID NO.: 75 | RASQLVSSAVA |
| S4-40 VL | CDR-L2 | Residues 50-56 of SEQ ID NO.: 75 | WASTRHS |
| S4-40 VL | CDR-L3 | Residues 89-97 of SEQ ID NO.: 75 | QQHYRTPFS |
| S4-17 VL | | SEQ ID NO.: 76 | DIQMTQSPSSLSASVGDRVTITCRASQLVS SAVAWYQQKPGKAPKLLIYWASTRHSGVPS RFSGSGSGTDFTLTISSLQPEDFATYYCQQ HYRTPFTFGQGTKLEIKR |
| S4-17 VL | CDR-L1 | Residues 24-34 of SEQ ID NO.: 76 | RASQLVSSAVA |
| S4-17 VL | CDR-L2 | Residues 50-56 of SEQ ID NO.: 76 | WASTRHS |
| S4-17 VL | CDR-L3 | Residues 89-97 of SEQ ID NO.: 76 | QQHYRTPFT |
| S4-54 VL | | SEQ ID NO.: 77 | DIQMTQSPSSLSASVGDRVTITCRASQLVS SAVAWYQQKPGKAPKLLIYWASARHTGVPS RFSGSGSGTDFTLTISSLQPEDFATYYCQQ HYKTPFSFGQGTKLEIKR |
| S4-54 VL | CDR-L1 | Residues 24-34 of SEQ ID NO.: 77 | RASQLVSSAVA |
| S4-54 VL | CDR-L2 | Residues 50-56 of SEQ ID NO.: 77 | WASARHT |
| S4-54 VL | CDR-L3 | Residues 89-97 of SEQ ID NO.: 77 | QQHYKTPFS |
| S4-12 VL | | SEQ ID NO.: 78 | DIQMTQSPSSLSASVGDRVTITCRASQLVS SAVAWYQQKPGKAPKLLIYWASARHTGVPS RFSGSGSGTDFTLTISSLQPEDFATYYCQQ HYKTPFTFGQGTKLEIKR |
| S4-12 VL | CDR-L1 | Residues 24-34 of SEQ ID NO.: 78 | RASQLVSSAVA |
| S4-12 VL | CDR-L2 | Residues 50-56 of SEQ ID NO.: 78 | WASARHT |

TABLE 1E-continued

Humanized Anti-TNF MAK-195 Ab VL sequences of IgG converted clones

| Protein | region | SEQ ID NO. | Sequence<br>12345678901234567890123456789 0 |
|---|---|---|---|
| S4-12<br>VL | CDR-<br>L3 | Residues 89-97<br>of SEQ<br>ID NO.: 78 | QQHYKTPFT |
| S4-74<br>VL | | SEQ ID<br>NO.: 79 | DIQMTQSPSSLSASVGDRVTITCRASQLVS<br>SAVAWYQQKPGKAPKLLIYWASARHTGVPS<br>RFSGSGSGTDFTLTISSLQPEDFATYYCQQ<br>HYRTPFTFGQGTKLEIKR |
| S4-74<br>VL | CDR-<br>L1 | Residues 24-34<br>of SEQ ID<br>NO.: 79 | RASQLVSSAVA |
| S4-74<br>VL | CDR-<br>L2 | Residues 50-56<br>of SEQ ID<br>NO.: 79 | WASARHT |
| S4-74<br>VL | CDR-<br>L3 | Residues 89-97<br>of SEQ<br>ID NO.: 79 | QQHYRTPFT |
| S4-34<br>VL | | SEQ ID<br>NO.: 80 | DIQMTQSPSSLSASVGDRVTITCRASQLVS<br>SAVAWYQQKPGKAPKLLIYWASTRHTGVPS<br>RFSGSGSGTDFTLTISSLQPEDFATYYCQQ<br>HYRTPFTFGQGTKLEIKR |
| S4-34<br>VL | CDR-<br>L1 | Residues 24-34<br>of SEQ ID<br>NO.: 80 | RASQLVSSAVA |
| S4-34<br>VL | CDR-<br>L2 | Residues 50-56<br>of SEQ ID<br>NO.: 80 | WASTRHT |
| S4-34<br>VL | CDR-<br>L3 | Residues 89-97<br>of SEQ<br>ID NO.: 80 | QQHYRTPFT |
| S4-31<br>VL | | SEQ ID<br>NO.: 81 | DIQMTQSPSSLSASVGDRVTITCRASQGVS<br>SALAWYQQKPGKAPKLLIYWASALHSGVPS<br>RFSGSGSGTDFTLTISSLQPEDFATYYCQQ<br>HYSAPFTFGQGTKLEIKR |
| S4-31<br>VL | CDR-<br>L1 | Residues 24-34<br>of SEQ ID<br>NO.: 81 | RASQGVSSALA |
| S4-31<br>VL | CDR-<br>L2 | Residues 50-56<br>of SEQ ID<br>NO.: 81 | WASALHS |
| S4-31<br>VL | CDR-<br>L3 | Residues 89-97<br>of SEQ<br>ID NO.: 81 | QQHYSAPFT |
| S4-18<br>VL | | SEQ ID<br>NO.: 82 | DIQMTQSPSSLSASVGDRVTITCRASQLVS<br>SAVAWYQQKPGKAPKLLIYWASTLHSGVPS<br>RFSGSGSGTDFTLTISSLQPEDFATYYCQQ<br>HYSTPFTFGQGTKLEIKR |
| S4-18<br>VL | CDR-<br>L1 | Residues 24-34<br>of SEQ ID<br>NO.: 82 | RASQLVSSAVA |
| S4-18<br>VL | CDR-<br>L2 | Residues 50-56<br>of SEQ ID<br>NO.: 82 | WASTLHS |
| S4-18<br>VL | CDR-<br>L3 | Residues 89-97<br>of SEQ<br>ID NO.: 82 | QQHYSTPFT |
| S4-6<br>VL | | SEQ ID<br>NO.: 83 | DIQMTQSPSSLSASVGDRVTITCKASQLVS<br>SAVAWYQQKPGKAPKLLIYWASTRHTGVPS<br>RFSGSGSGTDFTLTISSLQPEDFATYYCQQ<br>HYSTPFTFGQGTKLEIKR |
| S4-6<br>VL | CDR-<br>L1 | Residues 24-34<br>of SEQ ID<br>NO.: 83 | KASQLVSSAVA |
| S4-6<br>VL | CDR-<br>L2 | Residues 50-56<br>of SEQ ID<br>NO.: 83 | WASTRHT |
| S4-6<br>VL | CDR-<br>L3 | Residues 89-97<br>of SEQ<br>ID NO.: 83 | QQHYSTPFT |

TABLE 1E-continued

Humanized Anti-TNF MAK-195 Ab VL sequences of IgG converted clones

| Protein | region | SEQ ID NO. | Sequence<br>123456789012345678901234567890 |
|---|---|---|---|
| S4-55 VL | | SEQ ID NO.: 84 | DIQMTQSPSSLSASVGDRVTITCKASQLVS SAVAWYQQKPGKAPKLLIYWASTLHTGVPS RFSGSGSGTDFTLTISSLQPEDFATYYCQQ HYRTPFTFGQGTKLEIKR |
| S4-55 VL | CDR-L1 | Residues 24-34 of SEQ ID NO.: 84 | KASQLVSSAVA |
| S4-55 VL | CDR-L2 | Residues 50-56 of SEQ ID NO.: 84 | WASTLHT |
| S4-55 VL | CDR-L3 | Residues 89-97 of SEQ ID NO.: 84 | QQHYRTPFT |
| S4-63 VL | | SEQ ID NO.: 85 | DIQMTQSPSSLSASVGDRVTITCKASQKVS SALAWYQQKPGKAPKLLIYWASALHSGVPS RFSGSGSGTDFTLTISSLQPEDFATYYCQQ HYRPPFTFGQGTKLEIKR |
| S4-63 VL | CDR-L1 | Residues 24-34 of SEQ ID NO.: 85 | KASQKVSSALA |
| S4-63 VL | CDR-L2 | Residues 50-56 of SEQ ID NO.: 85 | WASALHS |
| S4-63 VL | CDR-L3 | Residues 89-97 of SEQ ID NO.: 85 | QQHYRPPFT |
| S4-50 VL | | SEQ ID NO.: 86 | DIQMTQSPSSLSASVGDRVTITCKASQLVS SAVAWYQQKPGKAPKLLIYWASALHTGVPS RFSGSGSGTDFTLTISSLQPEDFATYYCQQ HYSSPYTFGQGTKLEIKR |
| S4-50 VL | CDR-L1 | Residues 24-34 of SEQ ID NO.: 86 | KASQLVSSAVA |
| S4-50 VL | CDR-L2 | Residues 50-56 of SEQ ID NO.: 86 | WASALHT |
| S4-50 VL | CDR-L3 | Residues 89-97 of SEQ ID NO.: 86 | QQHYSSPYT |
| S4-19 VL | | SEQ ID NO.: 87 | DIQMTQSPSSLSASVGDRVTITCKASQLVS SAVAWYQQKPGKAPKLLIYWASTLHTGVPS RFSGSGSGTDFTLTISSLQPEDFATYYCQQ HYRTPFTFGQGTKLEIKR |
| S4-19 VL | CDR-L1 | Residues 24-34 of SEQ ID NO.: 87 | KASQLVSSAVA |
| S4-19 VL | CDR-L2 | Residues 50-56 of SEQ ID NO.: 87 | WASTLHT |
| S4-19 VL | CDR-L3 | Residues 89-97 of SEQ ID NO.: 87 | QQHYRTPFT |

The tables below provide a list of humanized MAK-199 antibodies that were converted into IgG proteins for characterization, both VH and VL sequences.

TABLE 1F

Humanized Anti-TNF MAK-199 Ab VH sequences of IgG converted clones

| Protein region | SEQ ID NO | Sequence 12345678901234567890123456 7890 |
|---|---|---|
| J662M2S3#10 VH | SEQ ID NO.: 88 | EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSS |
| J662M2S3#10 VH CDR-H1 | Residues 31-35 of SEQ ID NO.: 88 | NYGII |
| J662M2S3#10 VH CDR-H2 | Residues 50-66 of SEQ ID NO.: 88 | WINTYTGKPTYAQKFQG |
| J662M2S3#10 VH CDR-H3 | Residues 99-112 of SEQ ID NO.: 88 | RASQDISQYLN |
| J662M2S3#13 VH | SEQ ID NO.: 89 | EVQLVQSGAEVKKPGASVKVSCKASGYTFNNYGIIWVRQAPGQGLEWMGWINTYTGKPTYAQKLQGRVTMTTDTSTSTAYMELSSLRSEDTAVYFCARKLFNTVDVTDNAMDYWGQGTTVTVSS |
| J662M2S3#13 VH CDR-H1 | Residues 31-35 of SEQ ID NO.: 89 | NYGII |
| J662M2S3#13 VH CDR-H2 | Residues 50-66 of SEQ ID NO.: 89 | WINTYTGKPTYAQKLQG |
| J662M2S3#13 VH CDR-H3 | Residues 99-112 of SEQ ID NO.: 89 | KLFNTVDVTDNAMD |
| J662M2S3#15 VH | SEQ ID NO.: 90 | EVQLVQSGAEVKKPGASVKVSCKASGYTFNNYGIIWVRQAPGQGLEWMGWINTYTGVPTYAQKFQGRVTMTTDTSTSTAYMELSSLRSEDTAVYYCARKLFNTVDVTDNAMDYWGQGTTVTVSS |
| J662M2S3#15 VH CDR-H1 | Residues 31-35 of SEQ ID NO.: 90 | NYGII |
| J662M2S3#15 VH CDR-H2 | Residues 50-66 of SEQ ID NO.: 90 | WINTYTGVPTYAQKFQG |
| J662M2S3#15 VH CDR-H3 | Residues 99-112 of SEQ ID NO.: 90 | KLFNTVDVTDNAMD |
| J662M2S3#16 VH | SEQ ID NO.: 91 | EVQLVQSGAEVKKPGASVKVSCKASGYTFNNYGIIWVRQAPGQGLEWMGWINTYTGKPTYAQKFQGRVTMTTDTSTSTAYMELSSLRSEDTAVYYCARKLFNTVAVTDNAMDYWGQGTTVTVSS |
| J662M2S3#16 VH CDR-H1 | Residues 31-35 of SEQ ID NO.: 91 | NYGII |
| J662M2S3#16 VH CDR-H2 | Residues 50-66 of SEQ ID NO.: 91 | WINTYTGKPTYAQKFQG |
| J662M2S3#16 VH CDR-H3 | Residues 99-112 of SEQ ID NO.: 91 | KLFNTVAVTDNAMD |
| J662M2S3#21 VH | SEQ ID NO.: 92 | EVQLVQSGAEVKKPGASVKVSCKASGYTFRNYGIIWVRQAPGQGLEWMGWINTYTGKPTYAQKFQGRVTMTTDTSTSTAYMELSSLRSEDTAVYFCARKLFTTVDVTDNAMDYWGQGTTVTVSS |
| J662M2S3#21 VH CDR-H1 | Residues 31-35 of SEQ ID NO.: 92 | NYGII |
| J662M2S3#21 VH CDR-H2 | Residues 50-66 of SEQ ID NO.: 92 | WINTYTGKPTYAQKFQG |
| J662M2S3#21 VH CDR-H3 | Residues 99-112 of SEQ ID NO.: 92 | KLFTTVDVTDNAMD |

TABLE 1F-continued

Humanized Anti-TNF MAK-199 Ab VH sequences of IgG converted clones

| Protein region | | SEQ ID NO | Sequence<br>1234567890123456789012345678 90 |
|---|---|---|---|
| J662M2S3#34 VH | | SEQ ID NO.: 93 | EVQLVQSGAEVKKPGASVKVSCKASGYTFNNYGINWVRQAPGQGLEWMGWINTYTGKPTYAQKFQGRVTMTTDTSTSTAYMELSSLRSEDTAVYFCARKFRNTVAVTDYAMDYWGQGTTVTVSS |
| J662M2S3#34 VH | CDR-H1 | Residues 31-35 of SEQ ID NO.: 93 | NYGIN |
| J662M2S3#34 VH | CDR-H2 | Residues 50-66 of SEQ ID NO.: 93 | WINTYTGKPTYAQKFQG |
| J662M2S3#34 VH | CDR-H3 | Residues 99-112 of SEQ ID NO.: 93 | KFRNTVAVTDYAMD |
| J662M2S3#36 VH | | SEQ ID NO.: 94 | EVQLVQSGAEVKKPGASVKVSCKASGYTFRNYGITWVRQAPGQGLEWMGWINTYTGKPTYAQKFQGRVTMTTDTSTSTAYMELSSLRSEDTAVYFCARKLFTTMDVTDNAMDYWGQGTTVTVSS |
| J662M2S3#36 VH | CDR-H1 | Residues 31-35 of SEQ ID NO.: 94 | NYGIT |
| J662M2S3#36 VH | CDR-H2 | Residues 50-66 of SEQ ID NO.: 94 | WINTYTGKPTYAQKFQG |
| J662M2S3#36 VH | CDR-H3 | Residues 99-112 of SEQ ID NO.: 94 | KLFTTMDVTDNAMD |
| J662M2S3#45 VH | | SEQ ID NO.: 95 | EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSS |
| J662M2S3#45 VH | CDR-H1 | Residues 31-35 of SEQ ID NO.: 95 | NYGII |
| J662M2S3#45 VH | CDR-H2 | Residues 50-66 of SEQ ID NO.: 95 | WINTYTGKPTYAQKFQG |
| J662M2S3#45 VH | CDR-H3 | Residues 99-112 of SEQ ID NO.: 95 | KLFTTMDVTDNAMD |
| J662M2S3#58 VH | | SEQ ID NO.: 96 | EVQLVQSGAEVKKPGASVKVSCKASGYTFSNYGINWVRQAPGQGLEWMGWINTYTGQPSYAQKFQGRVTMTTDTSTSTAYMELSSLRSEDTAVYYCARKLFKTEAVTDYAMDYWGQGTTVTVSS |
| J662M2S3#58 VH | CDR-H1 | Residues 31-35 of SEQ ID NO.: 96 | NYGIN |
| J662M2S3#58 VH | CDR-H2 | Residues 50-66 of SEQ ID NO.: 96 | WINTYTGQPSYAQKFQG |
| J662M2S3#58 VH | CDR-H3 | Residues 99-112 of SEQ ID NO.: 96 | KLFKTEAVTDYAMD |
| J662M2S3#72 VH | | SEQ ID NO.: 97 | EVQLVQSGAEVKKPGASVKVSCKASGYTFNNYGIIWVRQAPGQGLEWMGWINTYSGKPTYAQKFQGRVTMTTDTSTSTAYMELSSLRSEDTAVYFCARKLFTTMDVTDNAMDYWGQGTTVTVSS |
| J662M2S3#72 VH | CDR-H1 | Residues 31-35 of SEQ ID NO.: 97 | NYGII |

TABLE 1F-continued

Humanized Anti-TNF MAK-199 Ab VH sequences of IgG converted clones

| Protein region | | SEQ ID NO | Sequence<br>123456789012345678901234567890 |
|---|---|---|---|
| J662M2S3#72 VH | CDR-H2 | Residues 50-66 of SEQ ID NO.: 97 | WINTYSGKPTYAQKFQG |
| J662M2S3#72 VH | CDR-H3 | Residues 99-112 of SEQ ID NO.: 97 | KLFTTMDVTDNAMD |

TABLE 1G

Humanized Anti-TNF MAK-199 Ab VL sequences of IgG converted clones

| Protein region | | SEQ ID NO | Sequence<br>123456789012345678901234567890 |
|---|---|---|---|
| J662M2S3#10 VL | | SEQ ID NO.: 98 | DIQMTQSPSSLSASVGDRVTITCRASQDIS QYLNWYQQKPGKAPKLLIYYTSRLQSGVPS RFSGSGSGTDFTLTISSLQPEDFATYFCQQ GNTWPPTFGQGTKLEIK |
| J662M2S3#10 VL | CDR-L1 | Residues 24-34 of SEQ ID NO.: 98 | RASQDISQYLN |
| J662M2S3#10 VL | CDR-L2 | Residues 50-56 of SEQ ID NO.: 98 | YTSRLQS |
| J662M2S3#10 VL | CDR-L3 | Residues 89-97 of SEQ ID NO.: 98 | QQGNTWPPT |
| J662M2S3#13 VL | | SEQ ID NO.: 99 | DIQMTQSPSSLSASVGDRVTITCRASQDIS NYLNWYQQKPGKAPKLLIYYTSRLQSGVPS RFSGSGSGTDYTLTISSLQPEDFATYFCQQ GNSWPPTFGQGTKLEIK |
| J662M2S3#13 VL | CDR-L1 | Residues 24-34 of SEQ ID NO.: 99 | RASQDISNYLN |
| J662M2S3#13 VL | CDR-L2 | Residues 50-56 of SEQ ID NO.: 99 | YTSRLQS |
| J662M2S3#13 VL | CDR-L3 | Residues 89-97 of SEQ ID NO.: 99 | QQGNSWPPT |
| J662M2S3#15 VL | | SEQ ID NO.: 100 | DIQMTQSPSSLSASVGDRVTITCRASQDIY NYLNWYQQKPGKAPKLLIYYTSRLQSGVPS RFSGSGSGTDYTLTISSLQPEDFATYFCQQ GNTQPPTFGQGTKLEIK |
| J662M2S3#15 VL | CDR-L1 | Residues 24-34 of SEQ ID NO.: 100 | RASQDIYNYLN |
| J662M2S3#15 VL | CDR-L2 | Residues 50-56 of SEQ ID NO.: 100 | YTSRLQS |
| J662M2S3#15 VL | CDR-L3 | Residues 89-97 of SEQ ID NO.: 100 | QQGNTQPPT |
| J662M2S3#16 VL | | SEQ ID NO.: 101 | DIQMTQSPSSDSASVGDRVTITCRASQDIE NYLNWYQQKPGKAPKLLIYYTSRLQSGVPS RFSGSGSGTDFTLTISSLQPEDFATYFCQQ GNTQPPTFGQGTKLEIK |
| J662M2S3#16 VL | CDR-L1 | Residues 24-34 of SEQ ID NO.: 101 | RASQDIENYLN |
| J662M2S3#16 VL | CDR-L2 | Residues 50-56 of SEQ ID NO.: 101 | YTSRLQS |
| J662M2S3#16 VL | CDR-L3 | Residues 89-97 of SEQ ID NO.: 101 | QQGNTQPPT |

TABLE 1G-continued

Humanized Anti-TNF MAK-199 Ab VL
sequences of IgG converted clones

| Protein region | | SEQ ID NO | Sequence<br>12345678901234567890123456789 0 |
|---|---|---|---|
| J662M2S3#21 VL | | SEQ ID NO.: 102 | DIQMTQSPSSDSASVGDRVTITCRASQDIS NYLNWYQQKPGKAPKLLIYYTSRLQSGVPS RFSGSGSGTDYTLTISSLQPEDFATYFCQQ GNTWPPTFGQGTKLEIK |
| J662M2S3#21 VL | CDR-L1 | Residues 24-34 of SEQ ID NO.: 102 | RASQDISNYLN |
| J662M2S3#21 VL | CDR-L2 | Residues 50-56 of SEQ ID NO.: 102 | YTSRLQS |
| J662M2S3#21 VL | CDR-L3 | Residues 89-97 of SEQ ID NO.: 102 | QQGNTWPPT |
| J662M2S3#34 VL | | SEQ ID NO.: 103 | DIQMTQSPSSDSASVGDRVTITCRASQDIY DVLNWYQQKPGKAPKLLIYYASRLQSGVPS RFSGSGSGTDFTLTISSLQPEDFATYYCQQ GITLPPTFGQGTKLEIK |
| J662M2S3#34 VL | CDR-L1 | Residues 24-34 of SEQ ID NO.: 103 | RASQDIYDVLN |
| J662M2S3#34 VL | CDR-L2 | Residues 50-56 of SEQ ID NO.: 103 | YASRLQS |
| J662M2S3#34 VL | CDR-L3 | Residues 89-97 of SEQ ID NO.: 103 | QQGITLPPT |
| J662M2S3#36 VL | | SEQ ID NO.: 104 | DIQMTQSPSSDSASVGDRVTITCRASQDIS NYLNWYQQKPGKAPKLLIYYTSRLQSGVPS RFSGSGSGTDYTLTISSLQPEDFATYFCQQ GNTWPPTFGQGTKLEIK |
| J662M2S3#36 VL | CDR-L1 | Residues 24-34 of SEQ ID NO.: 104 | RASQDISNYLN |
| J662M2S3#36 VL | CDR-L2 | Residues 50-56 of SEQ ID NO.: 104 | YTSRLQS |
| J662M2S3#36 VL | CDR-L3 | Residues 89-97 of SEQ ID NO.: 104 | QQGNTWPPT |
| J662M2S3#45 VL | | SEQ ID NO.: 105 | DIQMTQSPSSLSASVGDRVTITCRASQDIS QYLNWYQQKPGKAPKLLIYYTSRLQSGVPS RFSGSGSGTDFTLTISSLQPEDFATYFCQQ GNTWPPTFGQGTKLEIK |
| J662M2S3#45 VL | CDR-L1 | Residues 24-34 of SEQ ID NO.: 105 | RASQDISQYLN |
| J662M2S3#45 VL | CDR-L2 | Residues 50-56 of SEQ ID NO.: 105 | YTSRLQS |
| J662M2S3#45 VL | CDR-L3 | Residues 89-97 of SEQ ID NO.: 105 | QQGNTWPPT |
| J662M2S3#58 VL | | SEQ ID NO.: 106 | DIQMTQSPSSLSASVGDRVTITCRASQNIY NVLNWYQQKPGKAPKLLIYYASRLQSGVPS RFSGSGSGTDFTLTISSLQPEDFATYFCQQ GNTMPPTFGQGTKLEIK |
| J662M2S3#58 VL | CDR-L1 | Residues 24-34 of SEQ ID NO.: 106 | RASQNIYNVLN |
| J662M2S3#58 VL | CDR-L2 | Residues 50-56 of SEQ ID NO.: 106 | YASRLQS |
| J662M2S3#58 VL | CDR-L3 | Residues 89-97 of SEQ ID NO.: 106 | QQGNTMPPT |

TABLE 1G-continued

Humanized Anti-TNF MAK-199 Ab VL sequences of IgG converted clones

| Protein region | | SEQ ID NO | Sequence<br>12345678901234567890123456 7890 |
|---|---|---|---|
| J662M2S3#72<br>VL | | SEQ ID<br>NO.: 107 | DIQMTQSPSSLSASVGDRVTITCRASQDIS<br>NFLNWYQQKPGKAPKLLIYYTSRLQSGVPS<br>RFSGSGSGTDYTLTISSLQPEDFATYFCQQ<br>GNTQPPTFGQGTKLEIK |
| J662M2S3#72<br>VL | CDR-<br>L1 | Residues 24-34<br>of SEQ ID<br>NO.: 107 | RASQDISNFLN |
| J662M2S3#72<br>VL | CDR-<br>L2 | Residues 50-56<br>of SEQ ID<br>NO.: 107 | YTSRLQS |
| J662M2S3#72<br>VL | CDR-<br>L3 | Residues 89-97<br>of SEQ<br>ID NO.: 107 | QQGNTQPPT |

The following tables provide anti-IL-17 sequences from 20 converted clones.

TABLE 1H

Individual Anti-IL-17 Ab VH Sequences from Converted Clones for Generating DVD-Binding Proteins

| Protein region | | SEQ ID NO | Sequence<br>12345678901234567890123456 7890 |
|---|---|---|---|
| h10f7VH.1a.<br>g1m<br>VH | | SEQ ID<br>NO.: 108 | EVQLVQSGAEVKKPGSSVKVSCKASGYTFT<br>DYEIHWVRQAPGQGLEWIGVNDPESGGTFY<br>NQKFDGRATLTADKSTSTAYMELSSLRSED<br>TAVYYCTRYYRYESFYGMDYWGQGTTVTVS<br>S |
| h10f7VH.1a.<br>g1m<br>VH | CDR-<br>H1 | Residues 31-35<br>of SEQ ID<br>NO.: 108 | DYEIH |
| h10f7VH.1a.<br>g1m<br>VH | CDR-<br>H2 | Residues 50-66<br>of SEQ ID<br>NO.: 108 | VNDPESGGTFYNQKFDG |
| h10f7VH.1a.<br>g1m<br>VH | CDR-<br>H3 | Residues 99-110<br>of SEQ<br>ID NO.: 108 | YYRYESFYGMDY |
| J439M1S3R5<br>#10<br>VH | | SEQ ID<br>NO.: 109 | EVQLVQSGAEVKKPGSSVKVSCKASGYTFD<br>DYEIHWVRQAPGQGLEWIGVNDPESGGTFY<br>NQKFDGRATLTADKSTSTAYMELSSLRSED<br>TAVYYCTRYDKWDSFYGMDYWGQGTTVTVS<br>S |
| J439M1S3R5<br>#10<br>VH | CDR-<br>H1 | Residues 31-35<br>of SEQ ID<br>NO.: 109 | DYEIH |
| J439M1S3R5<br>#10<br>VH | CDR-<br>H2 | Residues 50-66<br>of SEQ ID<br>NO.: 109 | VNDPESGGTFYNQKFDG |
| J439M1S3R5<br>#10<br>VH | CDR-<br>H3 | Residues 99-110<br>of SEQ<br>ID NO.: 109 | YDKWDSFYGMDY |
| J439M1S3R5<br>#11<br>VH | | SEQ ID<br>NO.: 110 | EVQLVQSGAEVKKPGSSVKVSCKASGYTFT<br>DYEIHWVRQAPGQGLEWMGVNDPESGGTFY<br>NQKFDGRVTLTADESTSTAYMELSSLRSED<br>TAVYYCTRYSKWDSFDGMDYWGQGTTVTVS<br>S |
| J439M1S3R5<br>#11<br>VH | CDR-<br>H1 | Residues 31-35<br>of SEQ ID<br>NO.: 110 | DYEIH |
| J439M1S3R5<br>#11<br>VH | CDR-<br>H2 | Residues 50-66<br>of SEQ ID<br>NO.: 110 | VNDPESGGTFYNQKFDG |
| J439M1S3R5<br>#11<br>VH | CDR-<br>H3 | Residues 99-110<br>of SEQ<br>ID NO.: 110 | YSKWDSFDGMDY |

TABLE 1H-continued

Individual Anti-IL-17 Ab VH Sequences from Converted
Clones for Generating DVD-Binding Proteins

| Protein region | SEQ ID NO | Sequence<br>12345678901234567890 1234567890 |
|---|---|---|
| J439M1S2(H)3 #A6 VH | SEQ ID NO.: 111 | EVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYDKWYSFEGMDIWGQGTTVTVSS |
| 439M1S2(H)3 #A6 VH | CDR-H1 Residues 31-35 of SEQ ID NO.: 111 | DYEIH |
| 439M1S2(H)3 #A6 VH | CDR-H2 Residues 50-66 of SEQ ID NO.: 111 | VNDPDSGGTLYNQKFDG |
| 439M1S2(H)3 #A6 VH | CDR-H3 Residues 99-110 of SEQ ID NO.: 111 | YDKWYSFEGMDI |
| J439M1S2(H)3 #A11 VH | SEQ ID NO.: 112 | EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKYWSFEGMDYWGQGTTVTVSS |
| J439M1S2(H)3 #A11 VH | CDR-H1 Residues 31-35 of SEQ ID NO.: 112 | DYEIH |
| J439M1S2(H)3 #A11 VH | CDR-H2 Residues 50-66 of SEQ ID NO.: 112 | VNDPESGGTFYNQKFDG |
| J439M1S2(H)3 #A11 VH | CDR-H3 Residues 99-110 of SEQ ID NO.: 112 | YDKYWSFEGMDY |
| J439M1S2(H)3 #A16 VH | SEQ ID NO.: 113 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWYSFEGMDIWGQGTTVTVSS |
| J439M1S2(H)3 #A16 VH | CDR-H1 Residues 31-35 of SEQ ID NO.: 113 | DYEIH |
| J439M1S2(H)3 #A16 VH | CDR-H2 Residues 50-66 of SEQ ID NO.: 113 | VNDPESGGTFYNQKFDG |
| J439M1S2(H)3 #A16 VH | CDR-H3 Residues 99-110 of SEQ ID NO.: 113 | DKWYSFEGMDI |
| J439M1S2(H)3 #B13 VH | SEQ ID NO.: 114 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKYWSFEGMDYWGQGTTVTVSS |
| J439M1S2(H)3 #B13 VH | CDR-H1 Residues 31-35 of SEQ ID NO.: 114 | DYEIH |
| J439M1S2(H)3 #B13 VH | CDR-H2 Residues 50-66 of SEQ ID NO.: 114 | VNDPESGGTFYNQKFDG |
| J439M1S2(H)3 #B13 VH | CDR-H3 Residues 99-110 of SEQ ID NO.: 114 | DKYWSFEGMDY |
| J439M1S2(H)3 #B20 VH | SEQ ID NO.: 115 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKWYSFEGMDIWGQGTTVTVSS |
| J439M1S2(H)3 #B20 VH | CDR-H1 Residues 31-35 of SEQ ID NO.: 115 | DYEIH |

TABLE 1H-continued

Individual Anti-IL-17 Ab VH Sequences from Converted Clones for Generating DVD-Binding Proteins

| Protein region | | SEQ ID NO | Sequence<br>12345678901234567890 1234567890 |
|---|---|---|---|
| J439M1S2(H)3 #B20 VH | CDR-H2 | Residues 50-66 of SEQ ID NO.: 115 | VNDPESGGTFYNQKFDG |
| J439M1S2(H)3 #B20 VH | CDR-H3 | Residues 99-110 of SEQ ID NO.: 115 | DKWYSFEGMDI |

TABLE 1I

Individual Anti-IL-17 Ab VL Sequences from Converted Clones for Generating DVD-Binding Proteins

| Protein region | | SEQ ID No. | Sequence<br>12345678901234567890 1234567890 |
|---|---|---|---|
| J439M1S3R5 #10 VL | | SEQ ID NO.: 116 | DIQMTQSPSSLSASVGDRVTITCSASSGSI SYIDWFQQKPGKAPKRLIYATFELASGVPS RFSGSGSGTDFTLTISSLQPEDFATYYCHQ LGSYPDTFGQGTKLEIK |
| J439M1S3R5 #10 VL | CDR-L1 | Residues 24-34 of SEQ ID NO.: 116 | SASSGSISYID |
| J439M1S3R5 #10 VL | CDR-L2 | Residues 50-56 of SEQ ID NO.: 116 | ATFELAS |
| J439M1S3R5 #10 VL | CDR-L3 | Residues 89-97 of SEQ ID NO.: 116 | HQLGSYPDT |
| J439M1S3R5 #11 VL | | SEQ ID NO.: 117 | DIQMTQSPSSLSASVGDRVTITCRASSGII SYIDWFQQKPGKAPKRLIYATFDLASGVPS RFSGSGSGTDYTLTISSLQPEDFATYYCRQ VGSYPETFGQGTKLEIK |
| J439M1S3R5 #11 VL | CDR-L1 | Residues 24-34 of SEQ ID NO.: 117 | RASSGIISYID |
| J439M1S3R5 #11 VL | CDR-L2 | Residues 50-56 of SEQ ID NO.: 117 | ATFDLAS |
| J439M1S3R5 #11 VL | CDR-L3 | Residues 89-97 of SEQ ID NO.: 117 | RQVGSYPET |
| J427 M2S3 #12 VL | | SEQ ID NO.: 118 | DIQMTQSPSSLSASVGDRVTITCSASSGII SSIDWFQQKPGKAPKRLIYATFALQSGVPS RFSGSGSGTDFTLTISSLQPEDFATYYCSQ MSSYPHTFGQGTKLEIK |
| J427 M2S3 #12 VL | CDR-L1 | Residues 24-34 of SEQ ID NO.: 118 | SASSGIISSID |
| J427 M2S3 #12 VL | CDR-L2 | Residues 50-56 of SEQ ID NO.: 118 | ATFALQS |
| J427 M2S3 #12 VL | CDR-L3 | Residues 89-97 of SEQ ID NO.: 118 | SQMSSYPHT |
| J427 M2S3 #27 VL | | SEQ ID NO.: 119 | DIQMTQSPSSLSASVGDRVTITCSASSDIS SYLNWFQQKPGKSPKRLIYRTSELQSGVPS RFSGSGSGTDFTLTISSLQPEDFATYYCQQ WSSYPWTFGQGTKLEIK |
| J427 M2S3 #27 VL | CDR-L1 | Residues 24-34 of SEQ ID NO.: 119 | SASSDISSYLN |
| J427 M2S3 #27 VL | CDR-L2 | Residues 50-56 of SEQ ID NO.: 119 | RTSELQS |
| J427 M2S3 #27 VL | CDR-L3 | Residues 89-97 of SEQ ID NO.: 119 | QQWSSYPWT |

TABLE 1I-continued

Individual Anti-IL-17 Ab VL Sequences from Converted Clones for Generating DVD-Binding Proteins

| Protein region | SEQ ID No. | Sequence<br>12345678901234567890123456 7890 |
|---|---|---|
| J439M1S2(H)3 #A6 VL | SEQ ID NO.: 120 | DIQMTQSPSSLSASVGDRVTITCSASQGIR SYIDWFQQKPGKSPKRLIYATFDLASGVPS RFSGSGSGTDYTLTISSLQPEDFATYYCRQ VGNYPGTFGQGTKLEIK |
| J439M1S2(H)3 #A6 VL | CDR-L1 | Residues 24-34 of SEQ ID NO.: 120 | SASQGIRSYID |
| J439M1S2(H)3 #A6 VL | CDR-L2 | Residues 50-56 of SEQ ID NO.: 120 | ATFDLAS |
| J439M1S2(H)3 #A6 VL | CDR-L3 | Residues 89-97 of SEQ ID NO.: 120 | RQVGNYPGT |

Detailed description of specific DVD-binding protein molecules capable of binding specific targets, and methods of making the same, is provided in the Examples section below.

B) Production of DVD-Binding Proteins

The binding proteins provided herein may be produced by any of a number of techniques known in the art. For example, expression from host cells, wherein expression vector(s) encoding the DVD heavy and DVD light chains is (are) transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection and the like. Although it is possible to express the DVD-binding proteins provided herein in either prokaryotic or eukaryotic host cells, DVD proteins are expressed in eukaryotic cells, for example, mammalian host cells, because such eukaryotic cells (and in particular mammalian cells) are more likely than prokaryotic cells to assemble and secrete a properly folded and immunologically active DVD protein.

Exemplary mammalian host cells for expressing the recombinant antibodies provided herein include Chinese Hamster Ovary (CHO cells) (including dhfr-CHO cells, described in Urlaub and Chasin (1980) Proc. Natl. Acad. Sci. USA 77:4216-4220, used with a DHFR selectable marker, e.g., as described in Kaufman and Sharp (1982) Mol. Biol. 159:601-621), NS0 myeloma cells, COS cells, SP2 and PER.C6 cells. When recombinant expression vectors encoding DVD proteins are introduced into mammalian host cells, the DVD proteins are produced by culturing the host cells for a period of time sufficient to allow for expression of the DVD proteins in the host cells or secretion of the DVD proteins into the culture medium in which the host cells are grown. DVD proteins can be recovered from the culture medium using standard protein purification methods.

In an exemplary system for recombinant expression of DVD proteins provided herein, a recombinant expression vector encoding both the DVD heavy chain and the DVD light chain is introduced into dhfr-CHO cells by calcium phosphate-mediated transfection. Within the recombinant expression vector, the DVD heavy and light chain genes are each operatively linked to CMV enhancer/AdMLP promoter regulatory elements to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the DVD heavy and light chains and intact DVD protein is recovered from the culture medium. Standard molecular biology techniques are used to prepare the recombinant expression vector, transfect the host cells, select for transformants, culture the host cells and recover the DVD protein from the culture medium. A method of synthesizing a DVD protein provided herein by culturing a host cell provided herein in a suitable culture medium until a DVD protein is synthesized is also provided. The method can further comprise isolating the DVD protein from the culture medium.

An important feature of DVD-binding protein is that it can be produced and purified in a similar way as a conventional antibody. The production of DVD-binding protein results in a homogeneous, single major product with desired dual-specific activity, without any sequence modification of the constant region or chemical modifications of any kind. Other previously described methods to generate "bi-specific", "multi-specific", and "multi-specific multivalent" full length binding proteins do not lead to a single primary product but instead lead to the intracellular or secreted production of a mixture of assembled inactive, mono-specific, multi-specific, multivalent, full length binding proteins, and multivalent full length binding proteins with combination of different binding sites. As an example, based on the design described by Miller and Presta (PCT Publication No. WO2001/077342), there are 16 possible combinations of heavy and light chains. Consequently only 6.25% of protein is likely to be in the desired active form, and not as a single major product or single primary product compared to the other 15 possible combinations. Separation of the desired, fully active forms of the protein from inactive and partially active forms of the protein using standard chromatography techniques, typically used in large scale manufacturing, is yet to be demonstrated.

Surprisingly the design of the "dual-specific multivalent full length binding proteins" provided herein leads to a dual variable domain light chain and a dual variable domain heavy chain which assemble primarily to the desired "dual-specific multivalent full length binding proteins".

At least 50%, at least 75% and at least 90% of the assembled, and expressed dual variable domain immunoglobulin molecules are the desired dual-specific tetravalent protein. This embodiment particularly enhances commercial utility. Therefore, a method to express a dual variable domain light chain and a dual variable domain heavy chain in a single cell leading to a single primary product of a "dual-specific tetravalent full length binding protein" is provided.

Methods of expressing a dual variable domain light chain and a dual variable domain heavy chain in a single cell leading to a "primary product" of a "dual-specific tetravalent full length binding protein", where the "primary product" is more than 50%, such as more than 75% and more than 90%, of all assembled protein, comprising a dual variable domain light chain and a dual variable domain heavy chain are provided.

II) Derivatized DVD-Binding Proteins

One embodiment provides a labeled binding protein wherein the binding protein is derivatized or linked to another functional molecule (e.g., another peptide or protein). For example, a labeled binding protein can be derived by functionally linking a binding protein provided herein (by chemical coupling, genetic fusion, noncovalent association or otherwise) to one or more other molecular entities, such as another antibody (e.g., a bispecific antibody or a diabody), a detectable agent, a cytotoxic agent, a pharmaceutical agent, and/or a protein or peptide that can mediate association of the binding protein with another molecule (such as a streptavidin core region or a polyhistidine tag). Approaches to derivatizing proteins are exemplified in the art and within the skill of the person of ordinary skill in the art.

III) Uses of DVD-Binding Proteins

Given their ability to bind to two or more antigens the binding proteins provided herein can be used to detect the antigens (e.g., in a biological sample, such as serum or plasma), using a conventional immunoassay, such as an enzyme linked immunosorbent assays (ELISA), an radioimmunoassay (RIA) or tissue immunohistochemistry. The DVD-binding protein is directly or indirectly labeled with a detectable substance to facilitate detection of the bound or unbound antibody. Suitable detectable substances include various enzymes, prosthetic groups, fluorescent materials, luminescent materials and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; and examples of suitable radioactive material include $^{3}H$, $^{14}C$, $^{35}S$, $^{90}Y$, $^{99}Tc$, $^{111}In$, $^{125}I$, $^{131}I$, $^{177}Lu$, $^{166}Ho$, or $^{153}Sm$.

In an embodiment, the binding proteins provided herein are capable of neutralizing the activity of the antigens both in vitro and in vivo. Accordingly, such DVD-binding proteins can be used to inhibit antigen activity, e.g., in a cell culture containing the antigens, in human subjects or in other mammalian subjects having the antigens with which a binding protein provided herein cross-reacts. In another embodiment, a method for reducing antigen activity in a subject suffering from a disease or disorder in which the antigen activity is detrimental is provided. A binding protein provided herein can be administered to a human subject for therapeutic purposes.

The term "a disorder in which antigen activity is detrimental" is intended to include diseases and other disorders in which the presence of the antigen in a subject suffering from the disorder has been shown to be or is suspected of being either responsible for the pathophysiology of the disorder or a factor that contributes to a worsening of the disorder. Accordingly, a disorder in which antigen activity is detrimental is a disorder in which reduction of antigen activity is expected to alleviate the symptoms and/or progression of the disorder. Such disorders may be evidenced, for example, by an increase in the concentration of the antigen in a biological fluid of a subject suffering from the disorder (e.g., an increase in the concentration of antigen in serum, plasma, synovial fluid, etc. of the subject). Non-limiting examples of disorders that can be treated with the binding proteins provided herein include those disorders discussed below and in the section pertaining to pharmaceutical compositions comprising the binding proteins.

DVD-binding proteins are useful as therapeutic agents to simultaneously block two different targets to enhance efficacy/safety and/or increase patient coverage. Such targets may include soluble targets (TNF) and cell surface receptor targets (VEGFR and EGFR). It can also be used to induce redirected cytotoxicity between tumor cells and T cells (Her2 and CD3) for cancer therapy, or between autoreactive cell and effector cells for autoimmune disease or transplantation, or between any target cell and effector cell to eliminate disease-causing cells in any given disease.

In addition, DVD-binding protein can be used to trigger receptor clustering and activation when it is designed to target two different epitopes on the same receptor. This may have benefit in making agonistic and antagonistic anti-GPCR therapeutics. In this case, DVD-binding protein can be used to target two different epitopes (including epitopes on both the loop regions and the extracellular domain) on one cell for clustering/signaling (two cell surface molecules) or signaling (on one molecule). Similarly, a DVD-binding protein molecule can be designed to triger CTLA-4 ligation, and a negative signal by targeting two different epitopes (or 2 copies of the same epitope) of CTLA-4 extracellular domain, leading to down regulation of the immune response. CTLA-4 is a clinically validated target for therapeutic treatment of a number of immunological disorders. CTLA-4/B7 interactions negatively regulate T cell activation by attenuating cell cycle progression, IL-2 production, and proliferation of T cells following activation, and CTLA-4 (CD152) engagement can down-regulate T cell activation and promote the induction of immune tolerance. However, the strategy of attenuating T cell activation by agonistic antibody engagement of CTLA-4 has been unsuccessful since CTLA-4 activation requires ligation. The molecular interaction of CTLA-4/B7 is in "skewed zipper" arrays, as demonstrated by crystal structural analysis (Stamper 2001 Nature 410:608). However none of the currently available CTLA-4 binding reagents have ligation properties, including anti-CTLA-4 mAbs. There have been several attempts to address this issue. In one case, a cell member-bound single chain antibody was generated, and significantly inhibited allogeneic rejection in mice (Hwang 2002 JI 169:633). In a separate case, artificial APC surface-linked single-chain antibody to CTLA-4 was generated and demonstrated to attenuate T cell responses (Griffin 2000 JI 164:4433). In both cases, CTLA-4 ligation was achieved by closely localized member-bound antibodies in artificial systems. While these experiments provide proof-of-concept for immune down-regulation by triggering CTLA-4 negative signaling, the reagents used in these reports are not suitable for therapeutic use. To this end, CTLA-4 ligation may be achieved by using a DVD-binding protein molecule, which target two different epitopes (or 2 copies of the same epitope) of CTLA-4 extracellular domain. The rationale is that the distance spanning two binding sites of an IgG, approximately 150-

170 Å, is too large for active ligation of CTLA-4 (30-50 Å between 2 CTLA-4 homodimer). However the distance between the two binding sites on DVD-binding protein (one arm) is much shorter, also in the range of 30-50 Å, allowing proper ligation of CTLA-4.

Similarly, DVD-binding protein can target two different members of a cell surface receptor complex (e.g., IL-12R alpha and beta). Furthermore, DVD-binding protein can target CR1 and a soluble protein/pathogen to drive rapid clearance of the target soluble protein/pathogen.

Additionally, DVD-binding proteins provided herein can be employed for tissue-specific delivery (target a tissue marker and a disease mediator for enhanced local PK thus higher efficacy and/or lower toxicity), including intracellular delivery (targeting an internalizing receptor and a intracellular molecule), delivering to inside brain (targeting transferrin receptor and a CNS disease mediator for crossing the blood-brain barrier). DVD-binding protein can also serve as a carrier protein to deliver an antigen to a specific location via binding to a non-neutralizing epitope of that antigen and also to increase the half-life of the antigen. Furthermore, DVD-binding protein can be designed to either be physically linked to medical devices implanted into patients or target these medical devices (see Burke et al. (2006) Advanced Drug Deliv. Rev. 58(3): 437-446; Hildebrand et al. (2006) Surface and Coatings Technol. 200(22-23): 6318-6324; Drug/device combinations for local drug therapies and infection prophylaxis, Wu (2006) Biomaterials 27(11):2450-2467; Mediation of the cytokine network in the implantation of orthopedic devices, Marques (2005) Biodegradable Systems in Tissue Engineer. Regen. Med. 377-397). Briefly, directing appropriate types of cell to the site of medical implant may promote healing and restoring normal tissue function. Alternatively, inhibition of mediators (including but not limited to cytokines), released upon device implantation by a DVD coupled to or target to a device is also provided. For example, Stents have been used for years in interventional cardiology to clear blocked arteries and to improve the flow of blood to the heart muscle. However, traditional bare metal stents have been known to cause restenosis (re-narrowing of the artery in a treated area) in some patients and can lead to blood clots. Recently, an anti-CD34 antibody coated stent has been described which reduced restenosis and prevents blood clots from occurring by capturing endothelial progenitor cells (EPC) circulating throughout the blood. Endothelial cells are cells that line blood vessels, allowing blood to flow smoothly. The EPCs adhere to the hard surface of the stent forming a smooth layer that not only promotes healing but prevents restenosis and blood clots, complications previously associated with the use of stents (Aoji et al. (2005) J. Am. Coll. Cardiol. 45(10):1574-9). In addition to improving outcomes for patients requiring stents, there are also implications for patients requiring cardiovascular bypass surgery. For example, a prosthetic vascular conduit (artificial artery) coated with anti-EPC antibodies would eliminate the need to use arteries from patients legs or arms for bypass surgery grafts. This would reduce surgery and anesthesia times, which in turn will reduce coronary surgery deaths. DVD-binding protein are designed in such a way that it binds to a cell surface marker (such as CD34) as well as a protein (or an epitope of any kind, including but not limited to proteins, lipids and polysaccharides) that has been coated on the implanted device to facilitate the cell recruitment. Such approaches can also be applied to other medical implants in general. Alternatively, DVD-binding proteins can be coated on medical devices and upon implantation and releasing all DVDs from the device (or any other need which may require additional fresh DVD-binding protein, including aging and denaturation of the already loaded DVD-binding protein) the device could be reloaded by systemic administration of fresh DVD-binding protein to the patient, where the DVD-binding protein is designed to binds to a target of interest (a cytokine, a cell surface marker (such as CD34) etc.) with one set of binding sites and to a target coated on the device (including a protein, an epitope of any kind, including but not limited to lipids, polysaccharides and polymers) with the other. This technology has the advantage of extending the usefulness of coated implants.

C) Use of DVD-Binding Proteins in Various Diseases

DVD-binding protein molecules provided herein are also useful as therapeutic molecules to treat various diseases. Such DVD molecules may bind one or more targets involved in a specific disease. Examples of such targets in various diseases are described below.

1) Human Autoimmune and Inflammatory Response

TNF plays a critical role in the pathology associated with a variety of diseases involving immune and inflammatory elements, such as autoimmune diseases, particularly those associated with inflammation, including Crohn's disease, psoriasis (including plaque psoriasis), arthritis (including rheumatoid arthritis, psoratic arthritis, osteoarthritis, or juvenile idiopathic arthritis), multiple sclerosis, and ankylosing spondylitis. Therefore, the binding proteins herein may be used to treat these disorders. It is also involved in inflammatory and/or autoimmune conditions of various organs. IL-17 has been linked to many immune/autoimmune related diseases including rheumatoid arthritis, asthma, lupus, allograft rejection and anti-tumour immunity.

2) Asthma

Allergic asthma is characterized by the presence of eosinophilia, goblet cell metaplasia, epithelial cell alterations, airway hyperreactivity (AHR), and Th2 and Th1 cytokine expression, as well as elevated serum IgE levels. It is now widely accepted that airway inflammation is the key factor underlying the pathogenesis of asthma, involving a complex interplay of inflammatory cells such as T cells, B cells, eosinophils, mast cells and macrophages, and of their secreted mediators including cytokines and chemokines. Corticosteroids are the most important anti-inflammatory treatment for asthma today, however their mechanism of action is non-specific and safety concerns exist, especially in the juvenile patient population. The development of more specific and targeted therapies is therefore warranted.

TNF-α may amplify the inflammatory response in asthma and may be linked to disease severity (McDonnell et al. (2001) Progress Respir. Res. 31:247-250.).

Animal models such as OVA-induced asthma mouse model, where both inflammation and AHR can be assessed, are known in the art and may be used to determine the ability of various DVD-binding protein molecules to treat asthma.

3) Rheumatoid Arthritis

Rheumatoid arthritis (RA), a systemic disease, is characterized by a chronic inflammatory reaction in the synovium of joints and is associated with degeneration of cartilage and erosion of juxta-articular bone. Many pro-inflammatory cytokines including TNF, chemokines, and growth factors are expressed in diseased joints. Systemic administration of anti-TNF antibody or sTNFR fusion protein to mouse models of RA was shown to be anti-inflammatory and joint protective. Clinical investigations in which the activcity of TNF in RA patients was blocked with intravenously administered infliximab (Harriman G, Harper L K, Schaible T F. 1999 Summary of clinical trials in rheumatoid arthritis using infliximab, an anti-TNFalpha treatment. Ann Rheum Dis 58 Suppl 1:161-4), a chimeric anti-TNF mAb, has provided evidence that TNF regulates IL-6, IL-8, MCP-1, and VEGF production, recruitment of immune and inflammatory cells into joints, angiogenesis, and reduction of blood levels of matrix metalloproteinases-1 and -3. A better understanding of the inflammatory pathway in rheumatoid arthritis has led to identification of other therapeutic targets involved in rheumatoid arthritis. Promising treatments such as interleukin-6 antagonists (IL-6 receptor antibody MRA, developed by Chugai, Roche (see Nishimoto, Norihiro et al. (2004) Arthritis Rheum. 50(6):1761-1769), CTLA4Ig (abatacept, Genovese et al. (2005) N. Engl. J. Med. 353:1114-23.), and anti-B cell therapy (rituximab, Okamoto and Kamatani (2004) N. Engl. J. Med. 351:1909) have already been tested in randomized controlled trials over the past year. Other cytokines have been identified and have been shown to be of benefit in animal models, including interleukin-15 (therapeutic antibody HuMax-IL_15, AMG 714 see Baslund et al. (2005) Arthritis Rheum. 52(9): 2686-2692), interleukin-17, and interleukin-18, and clinical trials of these agents are currently under way. Dual-specific antibody therapy, combining anti-TNF and another mediator, has great potential in enhancing clinical efficacy and/or patient coverage. For example, blocking both TNF and VEGF can potentially eradicate inflammation and angiogenesis, both of which are involved in pathophysiology of RA. Blocking other pairs of targets involved in RA including, but not limited to, TNF and IL-18; TNF and IL-12; TNF and IL-23; TNF and IL-1beta; TNF and MIF; TNF and IL-17; and TNF and IL-15 with specific DVD-binding protein is also contemplated. In addition to routine safety assessments of these target pairs, specific tests for the degree of immunosuppression may be warranted and helpful in selecting the best target pairs (see Luster et al. (1994) Toxicology 92(1-3):229-43). Whether a DVD-binding protein molecule will be useful for the treatment of rheumatoid arthritis can be assessed using preclinical animal RA models such as the collagen-induced arthritis mouse model. Other useful models are also well known in the art (see Brand (2005) Comp. Med. 55(2):114-22). Based on the cross-reactivity of the parental antibodies for human and mouse othologues (e.g., reactivity for human and mouse TNF, human and mouse IL-15, etc.) validation studies in the mouse CIA model may be conducted with "matched surrogate antibody" derived DVD-binding protein molecules; briefly, a DVD-binding protein based on two (or more) mouse target specific antibodies may be matched to the extent possible to the characteristics of the parental human or humanized antibodies used for human DVD-binding protein construction (similar affinity, similar neutralization potency, similar half-life etc.).

4) Systemic Lupus Erythematosus (SLE)

The immunopathogenic hallmark of SLE is the polyclonal B cell activation, which leads to hyperglobulinemia, autoantibody production and immune complex formation. The fundamental abnormality appears to be the failure of T cells to suppress the forbidden B cell clones due to generalized T cell dysregulation. In addition, B and T-cell interaction is facilitated by several cytokines such as IL-10 as well as co-stimulatory molecules such as CD40 and CD40L, B7 and CD28 and CTLA-4, which initiate the second signal. These interactions together with impaired phagocytic clearance of immune complexes and apoptotic material, perpetuate the immune response with resultant tissue injury. SLE is considered to be a Th-2 driven disease with documented elevations in serum IL-4, IL-6, IL-10. DVD-binding proteins capable of binding one or more targets such as, for example IL-4, IL-6, IL-10, IFN-α, or TNF-α are also contemplated. Combination of targets discussed herein will enhance therapeutic efficacy for SLE which can be tested in a number of lupus preclinical models (see Peng (2004) Methods Mol. Med. 102:227-72). Based on the cross-reactivity of the parental antibodies for human and mouse othologues (e.g., reactivity for human and mouse CD20, human and mouse Interferon alpha etc.) validation studies in a mouse lupus model may be conducted with "matched surrogate antibody" derived DVD-binding protein molecules; briefly, a DVD-binding protein based two (or more) mouse target specific antibodies may be matched to the extent possible to the characteristics of the parental human or humanized antibodies used for human DVD-binding protein construction (similar affinity, similar neutralization potency, similar half-life etc.).

5) Multiple Sclerosis

Multiple sclerosis (MS) is a complex human autoimmune-type disease with a predominantly unknown etiology Immunologic destruction of myelin basic protein (MBP) throughout the nervous system is the major pathology of multiple sclerosis. MS is a disease of complex pathologies, which involves infiltration by CD4+ and CD8+ T cells and of response within the central nervous system. Expression in the CNS of cytokines, reactive nitrogen species and costimulator molecules have all been described in MS. Of major consideration are immunological mechanisms that contribute to the development of autoimmunity. In particular, antigen expression, cytokine and leukocyte interactions, and regulatory T-cells, which help balance/modulate other T-cells such as Th1 and Th2 cells, are important areas for therapeutic target identification.

TWEAK is a member of the TNF family, constitutively expressed in the central nervous system (CNS), with pro-inflammatory, proliferative or apoptotic effects depending upon cell types. Its receptor, Fn14, is expressed in CNS by endothelial cells, reactive astrocytes and neurons. TWEAK and Fn14 mRNA expression increased in spinal cord during experimental autoimmune encephalomyelitis (EAE). Anti-TWEAK antibody treatment in myelin oligodendrocyte glycoprotein (MOG) induced EAE in C57BL/6 mice resulted in a reduction of disease severity and leukocyte infiltration when mice were treated after the priming phase.

In one embodiment DVD Ig molecules capable of binding one or more, for example two, targets such as, for example IL-12, TWEAK, IL-23, CXCL13, CD40, CD40L, IL-18, VEGF, VLA-4, TNF, CD45RB, CD200, IFNgamma, GM-CSF, FGF, C5, CD52, or CCR2 are provided. An embodiment includes a dual-specific anti-IL-12/TWEAK DVD Ig as a therapeutic agent beneficial for the treatment of MS.

Several animal models for assessing the usefulness of the DVD molecules to treat MS are known in the art Based on the cross-reactivity of the parental antibodies for human and animal species othologues (e.g., reactivity for human and mouse IL-12, human and mouse TWEAK etc.) validation studies in the mouse EAE model may be conducted with "matched surrogate antibody" derived DVD-binding protein molecules; briefly, a DVD-binding protein based on to (or more) mouse target specific antibodies may be matched to the extent possible to the characteristics of the parental human or humanized antibodies used for human DVD-binding protein construction (similar affinity, similar neutralization potency, similar half-life etc.). The same concept applies to animal models in other non-rodent species, where a "matched surrogate antibody" derived DVD-binding protein would be selected for the anticipated pharmacology and possibly safety studies. In addition to routine safety assessments of these target pairs specific tests for the degree of immunosuppression may be warranted and helpful in selecting the best target pairs (see Luster et al. (1994) Toxicol. 92(1-3)).

MS is however not only an immunologic disease but has a very important neurodegenerative component. Disease progression in MS is due to cumulative loss and damage of axons and the final disease scores of the patients are determined by these neurodegenerative processes (Compston and Coles (2008) Lancet 372:1502-1517; Trapp and Nave (2008) Annu. Rev. Neurosci. 31: 247-269). Several mechanisms might account for axonal damage in MS. Excessive release of the neurotransmitter glutamate with associated calcium-mediated neurotoxicity, nitric-oxide release and subsequent axon damage, loss of neurotrophic support, massive accumulation of repulsive or axon growth inhibitory molecules like RGM A, NOGO A, Semaphorins, Ephrins, may contribute to axon-directed neurodegeneration and loss of successful axon regeneration. Targeting in a single DVD-binding protein molecule neutralizing activities directed against components like RGM A, NOGO A, Semaphorins, Ephrins with neutralizing activities directed against pro-inflammatory cytokines like IL-12, TWEAK, IL-23, CXCL13, CD40, CD40L, IL-18, VEGF, VLA-4, TNF, CD45RB, CD200, IFNgamma, GM-CSF, FGF, C5, CD52, and CCR2 would enable the simultaneous focus on inflammation and neuroregeneration, a goal not yet achieved by any of the current therapeutic MS principles. Stimulating neuroregeneration can compensate the functional impairments caused by the massive axonal neurodegeneration observed in MS, making recovery of lost cerebral functions possible.

6) Sepsis

The pathophysiology of sepsis is initiated by the outer membrane components of both gram-negative organisms (lipopolysaccharide [LPS], lipid A, endotoxin) and gram-positive organisms (lipoteichoic acid, peptidoglycan). These outer membrane components are able to bind to the CD14 receptor on the surface of monocytes. By virtue of the recently described toll-like receptors, a signal is then transmitted to the cell, leading to the eventual production of the proinflammatory cytokines tumor necrosis factor-alpha (TNF-alpha) and interleukin-1 (IL-1). Overwhelming inflammatory and immune responses are essential features of septic shock and play a central part in the pathogenesis of tissue damage, multiple organ failure, and death induced by sepsis. Cytokines, especially tumor necrosis factor (TNF) and interleukin (IL-1), have been shown to be mediators of septic shock. These cytokines have a direct toxic effect on tissues; they also activate phospholipase A2. These and other effects lead to increased concentrations of platelet-activating factor, promotion of nitric oxide synthase activity, promotion of tissue infiltration by neutrophils, and promotion of neutrophil activity.

The treatment of sepsis and septic shock remains a clinical conundrum, and recent prospective trials with biological response modifiers (i.e., anti-TNF, anti-MIF) aimed at the inflammatory response have shown only modest clinical benefit. Recently, interest has shifted toward therapies aimed at reversing the accompanying periods of immune suppression. In experimental animals, not only can treatment with inhibitors of apoptosis prevent lymphoid cell apoptosis; it may also improve outcome. Although clinical trials with anti-apoptotic agents remain distant due in large part to technical difficulties associated with their administration and tissue targeting, inhibition of lymphocyte apoptosis represents an attractive therapeutic target for the septic patient. Likewise, a dual-specific agent targeting both inflammatory mediator and a apoptotic mediator, may have added benefit. One embodiment pertains to DVD-binding proteins capable of binding one or more targets involved in sepsis, in an embodiment two targets, such as, for example TNF and IL-17. The efficacy of such DVD-binding protein for sepsis can be assessed in preclinical animal models known in the art (see Buras et al. (2005) Nat. Rev. Drug Discov. 4(10):854-65 and Calandra et al. (2000) Nat. Med. 6(2):164-70).

7) Neurological Disorders (a) Neurodegenerative Diseases

Neurodegenerative diseases are either chronic in which case they are usually age-dependent or acute (e.g., stroke, traumatic brain injury, spinal cord injury, etc.). These chronic neurodegenerative diseases represent a complex interaction between multiple cell types and mediators. Treatment strategies for such diseases are limited and mostly constitute either blocking inflammatory processes with non-specific anti-inflammatory agents (e.g., corticosteroids, COX inhibitors) or agents to prevent neuron loss and/or synaptic functions. These treatments fail to stop disease progression. Recent studies suggest that more targeted therapies such as antibodies to soluble A-b peptide (including the A-b oligomeric forms) can not only help stop disease progression but may help maintain memory and other cognitive functions as well. These preliminary observations suggest that specific therapies targeting more than one disease mediator (e.g., A-b and a pro-inflammatory cytokine such as TNF) may provide even better therapeutic efficacy for chronic neurodegenerative diseases than observed with targeting a single disease mechanism (e.g., soluble A-b alone).

The DVD-binding protein molecules provided herein can bind one or more targets involved in Chronic neurodegenerative diseases such as Alzheimers. Such targets include, but are not limited to, any mediator, soluble or cell surface, implicated in AD pathogenesis e.g., AGE (S100 A, amphoterin), pro-inflammatory cytokines (e.g., IL-1), chemokines (e.g., MCP 1), molecules that inhibit nerve regeneration (e.g., Nogo, RGM A), molecules that enhance neurite growth (neurotrophins) and molecules that can mediate transport at the blood brain barrier (e.g., transferrin receptor, insulin receptor or RAGE). The efficacy of DVD-binding protein molecules can be validated in pre-clinical animal models such as the transgenic mice that over-express amyloid precursor protein or RAGE and develop Alzheimer's disease-like symptoms. In addition, DVD-binding protein molecules can be constructed and tested for efficacy in the animal models and the best therapeutic DVD-binding protein can be selected for testing in human patients. DVD-binding protein molecules can also be employed for treatment of other neurodegenerative diseases such as Parkinson's disease. Alpha-Synuclein is involved in Parkinson's pathology. DVD-binding protein molecules capable of targeting alpha-synuclein and inflammatory mediators such as TNF, IL-1, MCP-1 can prove effective therapy for Parkinson's disease and are also embodiments.

Alternatively a DVD-binding protein capable of targeting alpha-synuclein and RGM A could not only halt the pathologic progress in the substantia nigra of Parkinson disease patients but could also result in regenerative growth of damaged neurites because RGM A has been recently shown to be strongly upregulated in this area in PD patients (Bossers et al. (2009) Brain Pathol. 19: 91-107).

(b) Neuronal Regeneration and Spinal Cord Injury

Despite an increase in knowledge of the pathologic mechanisms, spinal cord injury (SCI) is still a devastating condition and represents a medical indication characterized by a high medical need. No satisfying treatment exists and high dose bolus injection of methylprednisolone (MP) is the only used therapy within a narrow time window of 8 h post injury. This treatment, however, is only intended to prevent secondary injury without causing any significant functional recovery. It is heavily critisized for the lack of unequivocal efficacy and severe adverse effects, like immunosuppression with subsequent infections and severe histopathological muscle alterations. No other drugs, biologics or small molecules, stimulating the endogenous regenerative potential are approved, but promising treatment principles and drug candidates have shown efficacy in animal models of SCI in recent years and first promising clinical data have been presented just recently. To a large extent the lack of functional recovery in human SCI is caused by factors inhibiting neurite growth, at lesion sites, in scar tissue, in myelin as well as on injury-associated cells. Such factors are the myelin-associated proteins NogoA, OMgp and MAG, RGM A, the scar-associated CSPG (Chondroitin Sulfate Proteoglycans) and inhibitory factors on reactive astrocytes (some semaphorins and ephrins). However, at the lesion site not only growth inhibitory molecules are found but also neurite growth stimulating factors like neurotrophins, laminin, L1 and others. This ensemble of neurite growth inhibitory and growth promoting molecules may explain that blocking single factors, like NogoA or RGM A, resulted in significant functional recovery in rodent SCI models, because a reduction of the inhibitory influences could shift the balance from growth inhibition to growth promotion. However, recoveries observed with blocking a single neurite outgrowth inhibitory molecule were not complete. To achieve faster and more pronounced recoveries either blocking two neurite outgrowth inhibitory molecules e.g Nogo and RGM A, or blocking an neurite outgrowth inhibitory molecule and enhancing functions of a neurite outgrowth enhancing molecule e.g Nogo and neurotrophins, or blocking a neurite outgrowth inhibitory moleclule e.g., Nogo and a pro-inflammatory molecule e.g., TNF, may be desirable (see McGee et al., (2003) Trends Neurosci. 26:193).

In one aspect, DVD-binding proteins capable of binding target pairs such as NgR and RGM A; NogoA and RGM A; MAG and RGM A; OMGp and RGM A; RGM A and RGM B; RGM A and Semaphorin 3A; RGM A and Semaphorin 4; CSPGs and RGM A; aggrecan, midkine, neurocan, versican, phosphacan, Te38 and TNF-α; Aβ globulomer-specific antibodies combined with antibodies promoting dendrite & axon sprouting are provided. Dendrite pathology and axon damage, or neuritic dystrophy are a very early sign of AD and it is known that NOGO A restricts dendrite growth and that the other molecules associated with myelin and mentioned above e.g., RGM A, MAG, OMGp impair axonal regrowth. One can combine such type of ab with any of the SCI-candidate (myelin-proteins) Ab. Other DVD-binding protein targets may include any combination of NgR-p75, NgR-Troy, NgR-Nogo66 (Nogo), NgR-Lingo, Lingo-Troy, Lingo-p75, MAG or Omgp. Additionally, targets may also include any mediator, soluble or cell surface, implicated in inhibition of neurite e.g Nogo, Ompg, MAG, RGM A, semaphorins, ephrins, soluble A-b, pro-inflammatory cytokines (e.g., IL-1), chemokines (e.g., MIP 1a), molecules that inhibit nerve regeneration. The efficacy of anti-nogo/anti-RGM A or similar DVD-binding protein molecules can be validated in pre-clinical animal models of spinal cord injury.

In addition, these DVD-binding protein molecules can be constructed and tested for efficacy in the animal models and the best therapeutic DVD-binding protein can be selected for testing in human patients. In addition, DVD-binding protein molecules can be constructed that target two distinct ligand binding sites on a single receptor e.g., Nogo receptor which binds three ligand Nogo, OMGp, and MAG and RAGE that binds A-b and S100A. Furthermore, neurite outgrowth inihibitors e.g., nogo and nogo receptor, also play a role in preventing nerve regeneration in immunological diseases like multiple sclerosis. Inhibition of nogo-nogo receptor interaction has been shown to enhance recovery in animal models of multiple sclerosis. Therefore, DVD-binding protein molecules that can block the function of one immune mediator e.g., a cytokine like IL-12 and a neurite outgrowth inhibitor molecule e.g., nogo or RGM may offer faster and greater efficacy than blocking either an immune or an neurite outgrowth inhibitor molecule alone.

In general, antibodies do not cross the blood brain barrier (BBB) in an efficient and relevant manner. However, in certain neurologic diseases, e.g., stroke, traumatic brain injury, multiple sclerosis, etc., the BBB may be compromised and allows for increased penetration of DVD-binding proteins and antibodies into the brain. In other neurological conditions, where BBB leakage is not occurring, one may employ the targeting of endogenous transport systems, including carrier-mediated transporters such as glucose and amino acid carriers and receptor-mediated transcytosis-mediating cell structures/receptors at the vascular endothelium of the BBB, thus enabling trans-BBB transport of the DVD-binding protein. Structures at the BBB enabling such transport include but are not limited to the insulin receptor, transferrin receptor, LRP and RAGE. In addition, strategies enable the use of DVD-binding proteins also as shuttles to transport potential drugs into the CNS including low molecular weight drugs, nanoparticles and nucleic acids (Coloma et al. (2000) Pharm Res. 17(3):266-74; Boado et al. (2007) Bioconjug. Chem. 18(2):447-55).

8) Oncological Disorders

Monoclonal antibody therapy has emerged as an important therapeutic modality for cancer (von Mehren et al. (2003) Annu. Rev. Med. 54:343-69). Antibodies may exert antitumor effects by inducing apoptosis, redirected cytotoxicity, interfering with ligand-receptor interactions, or preventing the expression of proteins that are critical to the neoplastic phenotype. In addition, antibodies can target components of the tumor microenvironment, perturbing vital structures such as the formation of tumor-associated vasculature. Antibodies can also target receptors whose ligands are growth factors, such as the epidermal growth factor receptor. The antibody thus inhibits natural ligands that stimulate cell growth from binding to targeted tumor cells. Alternatively, antibodies may induce an anti-idiotype network, complement-mediated cytotoxicity, or antibody-dependent cellular cytotoxicity (ADCC). The use of dual-specific antibody that targets two separate tumor mediators will likely give additional benefit compared to a mono-specific therapy.

IV) Pharmaceutical Compositions

Pharmaceutical compositions comprising a binding protein and a pharmaceutically acceptable carrier are provided. The pharmaceutical compositions comprising binding proteins provided herein are for use in, but not limited to, diagnosing, detecting, or monitoring a disorder, in preventing, treating, managing, or ameliorating of a disorder or one or more symptoms thereof, and/or in research. In a specific embodiment, a composition comprises one or more binding proteins provided herein. In another embodiment, the pharmaceutical composition comprises one or more binding proteins provided herein and one or more prophylactic or therapeutic agents other than binding proteins provided herein for treating a disorder. In an embodiment, the prophylactic or therapeutic agents known to be useful for or having been or currently being used in the prevention, treatment, management, or amelioration of a disorder or one or more symptoms thereof. In accordance with these embodiments, the composition may further comprise of a carrier, diluent or excipient.

The binding proteins provided herein can be incorporated into pharmaceutical compositions suitable for administration to a subject. Typically, the pharmaceutical composition comprises a binding protein provided herein and a pharmaceutically acceptable carrier. The term "pharmaceutically acceptable carrier" includes any and all solvents, dispersion media, coatings, antibacterial and antifungal agents, isotonic and absorption delaying agents, and the like that are physiologically compatible. Examples of pharmaceutically acceptable carriers include one or more of water, saline, phosphate buffered saline, dextrose, glycerol, ethanol and the like, as well as combinations thereof. In some embodiments, isotonic agents, for example, sugars, polyalcohols such as mannitol, sorbitol, or sodium chloride, are included in the composition. Pharmaceutically acceptable carriers may further comprise minor amounts of auxiliary substances such as wetting or emulsifying agents, preservatives or buffers, which enhance the shelf life or effectiveness of the antibody or antibody binding portion.

Various delivery systems are known and can be used to administer one or more antibodies provided herein or the combination of one or more antibodies provided herein and a prophylactic agent or therapeutic agent useful for preventing, managing, treating, or ameliorating a disorder or one or more symptoms thereof, e.g., encapsulation in liposomes, microparticles, microcapsules, recombinant cells capable of expressing the antibody or antibody fragment, receptor-mediated endocytosis (see, e.g., Wu and Wu (1987) J. Biol. Chem. 262:4429-4432), construction of a nucleic acid as part of a retroviral or other vector, etc. Methods of administering a prophylactic or therapeutic agent provided herein include, but are not limited to, parenteral administration (e.g., intradermal, intramuscular, intraperitoneal, intravenous and subcutaneous), epidurala administration, intratumoral administration, and mucosal adminsitration (e.g., intranasal and oral routes). In addition, pulmonary administration can be employed, e.g., by use of an inhaler or nebulizer, and formulation with an aerosolizing agent. See, e.g., U.S. Pat. No. 6,019,968. In one embodiment, a binding protein provided herein, combination therapy, or a composition provided herein is administered using Alkermes AIR® pulmonary drug delivery technology (Alkermes, Inc., Cambridge, Mass.). In a specific embodiment, prophylactic or therapeutic agents provided herein are administered intramuscularly, intravenously, intratumorally, orally, intranasally, pulmonary, or subcutaneously. The prophylactic or therapeutic agents may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

In an embodiment, specific binding of antibody-coupled carbon nanotubes (CNTs) to tumor cells in vitro, followed by their highly specific ablation with near-infrared (NIR) light can be used to target tumor cells. For example, biotinylated polar lipids can be used to prepare stable, biocompatible, noncytotoxic CNT dispersions that are then attached to one or two different neutralite avidin-derivatized DVD-binding proteins directed against one or more tumor antigens (e.g., CD22) (Chakravarty et al. (2008) Proc. Natl. Acad. Sci. USA 105:8697-8702.

In a specific embodiment, it may be desirable to administer the prophylactic or therapeutic agents provided herein locally to the area in need of treatment; this may be achieved by, for example, and not by way of limitation, local infusion, by injection, or by means of an implant, the implant being of a porous or non-porous material, including membranes and matrices, such as sialastic membranes, polymers, fibrous matrices (e.g., Tissuel®), or collagen matrices. In one embodiment, an effective amount of one or more antibodies provided herein antagonists is administered locally to the affected area to a subject to prevent, treat, manage, and/or ameliorate a disorder or a symptom thereof. In another embodiment, an effective amount of one or more antibodies provided herein is administered locally to the affected area in combination with an effective amount of one or more therapies (e.g., one or more prophylactic or therapeutic agents) other than a binding protein provided herein to a subject to prevent, treat, manage, and/or ameliorate a disorder or one or more symptoms thereof.

In another embodiment, the prophylactic or therapeutic agent can be delivered in a controlled release or sustained release system. In one embodiment, a pump may be used to achieve controlled or sustained release (see Langer, supra; Sefton (1987) CRC Crit. Ref. Biomed. Eng. 14:20; Buchwald et al. (1980) Surgery 88:507; Saudek et al. (1989) N. Engl. J. Med. 321:574). In another embodiment, polymeric materials can be used to achieve controlled or sustained release of the therapies. In an embodiment, the polymer used in a sustained release formulation is inert, free of leachable impurities, stable on storage, sterile, and biodegradable. In yet another embodiment, a controlled or sustained release system can be placed in proximity of the prophylactic or therapeutic target, thus requiring only a fraction of the systemic dose (see, e.g., Goodson, in Medical Applications of Controlled Release, supra, vol. 2, pp. 115-138 (1984)).

Controlled release systems are discussed in the review by Langer (1990) Science 249:1527-1533). Any technique known to one of skill in the art can be used to produce sustained release formulations comprising one or more therapeutic agents provided herein.

In a specific embodiment, where the composition is a nucleic acid encoding a prophylactic or therapeutic agent, the nucleic acid can be administered in vivo to promote expression of its encoded prophylactic or therapeutic agent, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, Dupont), or coating with lipids or cell-surface receptors or transfecting agents, or by administering it in linkage to a homeobox-like peptide which is known to enter the nucleus (see, e.g., Joliot et al. (1991) Proc. Natl. Acad. Sci. USA 88:1864-1868). Alternatively, a nucleic acid can be introduced intracellularly and incorporated within host cell DNA for expression by homologous recombination.

A pharmaceutical composition provided herein is formulated to be compatible with its intended route of administration. Where useful, the composition may also include a solubilizing agent and a local anesthetic such as lignocamne to ease pain at the site of the injection.

The method may comprise administration of a composition formulated for parenteral administration by injection (e.g., by bolus injection or continuous infusion). Formulations for injection may be presented in unit dosage form (e.g., in ampoules or in multi-dose containers) with an added preservative. The compositions may take such forms as suspensions, solutions or emulsions in oily or aqueous vehicles, and may contain formulatory agents such as suspending, stabilizing and/or dispersing agents. Alternatively, the active ingredient may be in powder form for constitution with a suitable vehicle (e.g., sterile pyrogen-free water) before use.

The methods provided herein may additionally comprise of administration of compositions formulated as depot preparations. Such long acting formulations may be administered by implantation (e.g., subcutaneously or intramuscularly) or by intramuscular injection. Thus, for example, the compositions may be formulated with suitable polymeric or hydrophobic materials (e.g., as an emulsion in an acceptable oil) or ion exchange resins, or as sparingly soluble derivatives (e.g., as a sparingly soluble salt).

The methods provided herein encompass administration of compositions formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

Generally, the ingredients of compositions are supplied either separately or mixed together in unit dosage form, for example, as a dry lyophilized powder or water free concentrate in a hermetically sealed container such as an ampoule or sachette indicating the quantity of active agent. Where the mode of administration is infusion, composition can be dispensed with an infusion bottle containing sterile pharmaceutical grade water or saline. Where the mode of administration is by injection, an ampoule of sterile water for injection or saline can be provided so that the ingredients may be mixed prior to administration.

In one embodiment, one or more of the prophylactic or therapeutic agents, or pharmaceutical compositions provided herein is packaged in a hermetically sealed container such as an ampoule or sachette indicating the quantity of the agent. In one embodiment, one or more of the prophylactic or therapeutic agents, or pharmaceutical compositions provided herein is supplied as a dry sterilized lyophilized powder or water free concentrate in a hermetically sealed container and can be reconstituted (e.g., with water or saline) to the appropriate concentration for administration to a subject. In an embodiment, one or more of the prophylactic or therapeutic agents or pharmaceutical compositions provided herein is supplied as a dry sterile lyophilized powder in a hermetically sealed container at a unit dosage of at least 5 mg, at least 10 mg, at least 15 mg, at least 25 mg, at least 35 mg, at least 45 mg, at least 50 mg, at least 75 mg, or at least 100 mg. The lyophilized prophylactic or therapeutic agents or pharmaceutical compositions provided herein may be stored at between 2° C. and 8° C. in its original container and the prophylactic or therapeutic agents, or pharmaceutical compositions provided herein may be administered within 1 week, e.g., within 5 days, within 72 hours, within 48 hours, within 24 hours, within 12 hours, within 6 hours, within 5 hours, within 3 hours, or within 1 hour after being reconstituted. In an alternative embodiment, one or more of the prophylactic or therapeutic agents or pharmaceutical compositions provided herein is supplied in liquid form in a hermetically sealed container indicating the quantity and concentration of the agent. In an embodiment, the liquid form of the administered composition is supplied in a hermetically sealed container at least 0.25 mg/ml, at least 0.5 mg/ml, at least 1 mg/ml, at least 2.5 mg/ml, at least 5 mg/ml, at least 8 mg/ml, at least 10 mg/ml, at least 15 mg/kg, at least 25 mg/ml, at least 50 mg/ml, at least 75 mg/ml or at least 100 mg/ml. The liquid form may be stored at between 2° C. and 8° C. in its original container.

The binding proteins provided herein can be incorporated into a pharmaceutical composition suitable for parenteral administration. In an embodiment, the antibody or antibody-portions will be prepared as an injectable solution containing 0.1-250 mg/ml binding protein. The injectable solution can be composed of either a liquid or lyophilized dosage form in a flint or amber vial, ampule or pre-filled syringe. The buffer can be L-histidine (1-50 mM), optimally 5-10 mM, at pH 5.0 to 7.0 (optimally pH 6.0). Other suitable buffers include but are not limited to, sodium succinate, sodium citrate, sodium phosphate or potassium phosphate. Sodium chloride can be used to modify the toxicity of the solution at a concentration of 0-300 mM (optimally 150 mM for a liquid dosage form). Cryoprotectants can be included for a lyophilized dosage form, principally 0-10% sucrose (optimally 0.5-1.0%). Other suitable cryoprotectants include trehalose and lactose. Bulking agents can be included for a lyophilized dosage form, principally 1-10% mannitol (optimally 2-4%). Stabilizers can be used in both liquid and lyophilized dosage forms, principally 1-50 mM L-Methionine (optimally 5-10 mM). Other suitable bulking agents include glycine, arginine, can be included as 0-0.05% polysorbate-80 (optimally 0.005-0.01%). Additional surfactants include but are not limited to polysorbate 20 and BRIJ surfactants. The pharmaceutical composition comprising the binding proteins provided herein prepared as an injectable solution for parenteral administration, can further comprise an agent useful as an adjuvant, such as those used to increase the absorption, or dispersion of a therapeutic protein (e.g., antibody). A particularly useful adjuvant is hyaluronidase, such as Hylenex® (recombinant human hyaluronidase). Addition of hyaluronidase in the injectable solution improves human bioavailability following parenteral administration, particularly subcutaneous administration. It also allows for greater injection site volumes (i.e. greater than 1 ml) with less pain and discomfort, and minimum incidence of injection site reactions. (see WO2004078140 and US2006104968).

The compositions provided herein may be in a variety of forms. These include, for example, liquid, semi-solid and solid dosage forms, such as liquid solutions (e.g., injectable and infusible solutions), dispersions or suspensions, tablets, pills, powders, liposomes and suppositories. The form chosen depends on the intended mode of administration and therapeutic application. Typical compositions are in the form of injectable or infusible solutions, such as compositions similar to those used for passive immunization of humans with other antibodies. The chosen mode of administration is parenteral (e.g., intravenous, subcutaneous, intraperitoneal, intramuscular). In an embodiment, the antibody is administered by intravenous infusion or injection. In another embodiment, the antibody is administered by intramuscular or subcutaneous injection.

Therapeutic compositions typically must be sterile and stable under the conditions of manufacture and storage. The composition can be formulated as a solution, microemulsion, dispersion, liposome, or other ordered structure suitable to high drug concentration. Sterile injectable solutions can be prepared by incorporating the active compound (i.e., antibody or antibody binding portion) in the required amount in an appropriate solvent with one or a combination of ingredients enumerated herein, as required, followed by filtered sterilization. Generally, dispersions are prepared by incorporating the active compound into a sterile vehicle that contains a basic dispersion medium and the required other ingredients from those enumerated herein. In the case of sterile, lyophilized powders for the preparation of sterile injectable solutions, the methods of preparation are vacuum drying and spray-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including, in the composition, an agent that delays absorption, for example, monostearate salts and gelatin.

The binding proteins provided herein can be administered by a variety of methods known in the art, although for many therapeutic applications, in an embodiment, the route/mode of administration is subcutaneous injection, intravenous injection or infusion. As will be appreciated by the skilled artisan, the route and/or mode of administration will vary depending upon the desired results. In certain embodiments, the active compound may be prepared with a carrier that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., *Sustained and Controlled Release Drug Delivery Systems*, J. R. Robinson, ed., Marcel Dekker, Inc., New York, 1978.

Supplementary active compounds can also be incorporated into the compositions. In certain embodiments, a binding protein provided herein is coformulated with and/or coadministered with one or more additional therapeutic agents that are useful for treating disorders with a binding protein provided herein. For example, a binding protein provided herein may be coformulated and/or coadministered with one or more additional antibodies that bind other targets (e.g., antibodies that bind other cytokines or that bind cell surface molecules). Furthermore, one or more antibodies provided herein may be used in combination with two or more of the foregoing therapeutic agents. Such combination therapies may advantageously utilize lower dosages of the administered therapeutic agents, thus avoiding possible toxicities or complications associated with the various monotherapies.

In certain embodiments, a binding protein is linked to a half-life extending vehicle known in the art. Such vehicles include, but are not limited to, the Fc domain, polyethylene glycol, and dextran. Such vehicles are described, e.g., in U.S. application Ser. No. 09/428,082 and PCT Publication No. WO 99/25044.

In a specific embodiment, nucleic acid sequences encoding a binding protein provided herein or another prophylactic or therapeutic agent provided herein are administered to treat, prevent, manage, or ameliorate a disorder or one or more symptoms thereof by way of gene therapy. Gene therapy refers to therapy performed by the administration to a subject of an expressed or expressible nucleic acid. In this embodiment, the nucleic acids produce their encoded antibody or prophylactic or therapeutic agent provided herein that mediates a prophylactic or therapeutic effect.

Any of the methods for gene therapy available in the art can be used in the methods provided herein. For general reviews of the methods of gene therapy, see Goldspiel et al., 1993. Methods commonly known in the art of recombinant DNA technology which can be used are described in Ausubel et al. (eds.), Current Protocols in Molecular Biology, John Wiley &Sons, NY (1993); and Kriegler, Gene Transfer and Expression, A Laboratory Manual, Stockton Press, NY (1990). Detailed description of various methods of gene therapy are disclosed in US Patent Publication No. US20050042664.

A method for treating a human subject suffering from a disorder in which the target, or targets, capable of being bound by the binding protein disclosed herein is detrimental, comprising administering to the human subject a binding protein disclosed herein such that the activity of the target, or targets in the human subject is inhibited and one of more symptoms is alleviated or treatment is achieved is provided. In an embodiment, diseases that can be treated or diagnosed with the compositions and methods include, but are not limited to, immune and inflammatory elements, such as autoimmune diseases, particularly those associated with inflammation, including Crohn's disease, psoriasis (including plaque psoriasis), arthritis (including rheumatoid arthritis, psoratic arthritis, osteoarthritis, or juvenile idiopathic arthritis), multiple sclerosis, ankylosing spondylitis, systemic lupus erythematosus, multiple sclerosis, sepsis, and neurodegenerative diseases, neuronal regeneration, spinal cord injury, and primary and metastatic cancers. In another embodiment, the disorder is a respiratory disorder; asthma; allergic and nonallergic asthma; asthma due to infection; asthma due to infection with respiratory syncytial virus (RSV); chronic obstructive pulmonary disease (COPD); a condition involving airway inflammation; eosinophilia; fibrosis and excess mucus production; cystic fibrosis; pulmonary fibrosis; an atopic disorder; atopic dermatitis; urticaria; eczema; allergic rhinitis; allergic enterogastritis; an inflammatory and/or autoimmune condition of the skin; an inflammatory and/or autoimmune condition of gastrointestinal organs; inflammatory bowel diseases (IBD); ulcerative colitis; an inflammatory and/or autoimmune condition of the liver; liver cirrhosis; liver fibrosis; liver fibrosis caused by hepatitis B and/or C virus; scleroderma; tumors or cancers; hepatocellular carcinoma; glioblastoma; lymphoma; Hodgkin's lymphoma; a viral infection; a bacterial infection; a parasitic infection; HTLV-1 infection; suppression of expression of protective type 1 immune responses, and suppression of expression of a protective type 1 immune response during vaccination.

A binding protein provided herein also can be administered with one or more additional therapeutic agents useful in the treatment of various diseases.

A binding protein provided herein can be used alone or in combination to treat such diseases. It should be understood that the binding proteins can be used alone or in combination with an additional agent, e.g., a therapeutic agent, the additional agent being selected by the skilled artisan for its intended purpose. For example, the additional agent can be a therapeutic agent art-recognized as being useful to treat the disease or condition being treated by the antibody provided herein. The additional agent also can be an agent that imparts a beneficial attribute to the therapeutic composition e.g., an agent which effects the viscosity of the composition.

It should further be understood that the combinations provided herein are those combinations useful for their intended purpose. The agents set forth below are illustrative for purposes and not intended to be limited. In some embodiments, the combinations comprise the antibodies provided herein and at least one additional agent selected from the lists below. The combination can also include more than one additional agent, e.g., two or three additional agents if the combination is such that the formed composition can perform its intended function.

The pharmaceutical compositions provided herein may include a "therapeutically effective amount" or a "prophylactically effective amount" of a binding protein provided herein. A "therapeutically effective amount" refers to an amount effective, at dosages and for periods of time necessary, to achieve the desired therapeutic result. A therapeutically effective amount of the binding protein may be determined by a person skilled in the art and may vary according to factors such as the disease state, age, sex, and weight of the individual, and the ability of the binding protein to elicit a desired response in the individual. A therapeutically effective amount is also one in which any toxic or detrimental effects of the antibody, or antibody binding portion, are outweighed by the therapeutically beneficial effects. A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

Dosage regimens may be adjusted to provide the optimum desired response (e.g., a therapeutic or prophylactic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. The term "dosage unit form" refers to physically discrete units suited as unitary dosages for the mammalian subjects to be treated; each unit containing a predetermined quantity of active compound calculated to produce the desired therapeutic effect in association with the required pharmaceutical carrier. The specification for the dosage unit forms provided herein are dictated by and directly dependent on (a) the unique characteristics of the active compound and the particular therapeutic or prophylactic effect to be achieved, and (b) the limitations inherent in the art of compounding such an active compound for the treatment of sensitivity in individuals.

An exemplary, non-limiting range for a therapeutically or prophylactically effective amount of a binding protein provided herein is 0.1-20 mg/kg, for example, 1-10 mg/kg. It is to be noted that dosage values may vary with the type and severity of the condition to be alleviated. It is to be further understood that for any particular subject, specific dosage regimens may be adjusted over time according to the individual need and the professional judgment of the person administering or supervising the administration of the compositions, and that dosage ranges set forth herein are exemplary only and are not intended to limit the scope or practice of the claimed composition.

V) Diagnostics

The disclosure herein also provides diagnostic applications. This is further elucidated below.

A. Method of Assay

The present disclosure also provides a method for determining the presence, amount or concentration of an analyte (or a fragment thereof) in a test sample using at least one DVD-binding protein as described herein. Any suitable assay as is known in the art can be used in the method. Examples include, but are not limited to, immunoassay, such as sandwich immunoassay (e.g., monoclonal, polyclonal and/or DVD-binding protein sandwich immunoassays or any variation thereof (e.g., monoclonal/DVD-binding protein, DVD-binding protein/polyclonal, etc.), including radioisotope detection (radioimmunoassay (RIA)) and enzyme detection (enzyme immunoassay (EIA) or enzyme-linked immunosorbent assay (ELISA) (e.g., Quantikine ELISA assays, R&D Systems, Minneapolis, Minn.))), competitive inhibition immunoassay (e.g., forward and reverse), fluorescence polarization immunoassay (FPIA), enzyme multiplied immunoassay technique (EMIT), bioluminescence resonance energy transfer (BRET), and homogeneous chemiluminescent assay, etc. In a SELDI-based immunoassay, a capture reagent that specifically binds an analyte (or a fragment thereof) of interest is attached to the surface of a mass spectrometry probe, such as a pre-activated protein chip array. The analyte (or a fragment thereof) is then specifically captured on the biochip, and the captured analyte (or a fragment thereof) is detected by mass spectrometry. Alternatively, the analyte (or a fragment thereof) can be eluted from the capture reagent and detected by traditional MALDI (matrix-assisted laser desorption/ionization) or by SELDI. A chemiluminescent microparticle immunoassay, in particular one employing the ARCHITECT® automated analyzer (Abbott Laboratories, Abbott Park, Ill.), is an example of a preferred immunoassay.

Methods well-known in the art for collecting, handling and processing urine, blood, serum and plasma, and other body fluids, are used in the practice of the present disclosure, for instance, when a DVD-binding protein as described herein is employed as an immunodiagnostic reagent and/or in an analyte immunoassay kit. The test sample can comprise further moieties in addition to the analyte of interest, such as antibodies, antigens, haptens, hormones, drugs, enzymes, receptors, proteins, peptides, polypeptides, oligonucleotides and/or polynucleotides. For example, the sample can be a whole blood sample obtained from a subject. It can be necessary or desired that a test sample, particularly whole blood, be treated prior to immunoassay as described herein, e.g., with a pretreatment reagent. Even in cases where pretreatment is not necessary (e.g., most urine samples), pretreatment optionally can be done (e.g., as part of a regimen on a commercial platform).

The pretreatment reagent can be any reagent appropriate for use with the immunoassay and kits provided herein. The pretreatment optionally comprises: (a) one or more solvents (e.g., methanol and ethylene glycol) and optionally, salt, (b) one or more solvents and salt, and optionally, detergent, (c) detergent, or (d) detergent and salt. Pretreatment reagents are known in the art, and such pretreatment can be employed, e.g., as used for assays on Abbott TDx, AxSYM®, and ARCHITECT® analyzers (Abbott Laboratories, Abbott Park, Ill.), as described in the literature (see, e.g., Yatscoff et al. (1990) Clin. Chem. 36:1969-1973 and Wallemacq et al. (1999) Clin. Chem. 45: 432-435), and/or as commercially available. Additionally, pretreatment can be done as described in U.S. Pat. Nos. 5,135,875 and 6,660,843; European Patent Publication No. EU0471293, US Patent Application No. 20080020401. The pretreatment reagent can be a heterogeneous agent or a homogeneous agent.

With use of a heterogeneous pretreatment reagent, the pretreatment reagent precipitates analyte binding protein (e.g., protein that can bind to an analyte or a fragment thereof) present in the sample. Such a pretreatment step comprises removing any analyte binding protein by separating from the precipitated analyte binding protein the supernatant of the mixture formed by addition of the pretreatment agent to sample. In such an assay, the supernatant of the mixture absent any binding protein is used in the assay, proceeding directly to the antibody capture step.

With use of a homogeneous pretreatment reagent there is no such separation step. The entire mixture of test sample and pretreatment reagent are contacted with a labeled specific binding partner for analyte (or a fragment thereof), such as a labeled anti-analyte antibody (or an antigenically reactive fragment thereof). The pretreatment reagent employed for such an assay typically is diluted in the pretreated test sample mixture, either before or during capture by the first specific binding partner. Despite such dilution, a certain amount of the pretreatment reagent is still present (or remains) in the test sample mixture during capture. In one embodiment, the labeled specific binding partner can be a DVD-binding protein (or a fragment, a variant, or a fragment of a variant thereof).

In a heterogeneous format, after the test sample is obtained from a subject, a first mixture is prepared. The mixture contains the test sample being assessed for an analyte (or a fragment thereof) and a first specific binding partner, wherein the first specific binding partner and any analyte contained in the test sample form a first specific binding partner-analyte complex. Preferably, the first specific binding partner is an anti-analyte antibody or a fragment thereof. The first specific binding partner can be a DVD-binding protein (or a fragment, a variant, or a fragment of a variant thereof) as described herein. The order in which the test sample and the first specific binding partner are added to form the mixture is not critical. Preferably, the first specific binding partner is immobilized on a solid phase. The solid phase used in the immunoassay (for the first specific binding partner and, optionally, the second specific binding partner) can be any solid phase known in the art, such as, but not limited to, a magnetic particle, a bead, a test tube, a microtiter plate, a cuvette, a membrane, a scaffolding molecule, a film, a filter paper, a disc and a chip.

After the mixture containing the first specific binding partner-analyte complex is formed, any unbound analyte is removed from the complex using any technique known in the art. For example, the unbound analyte can be removed by washing. Desirably, however, the first specific binding partner is present in excess of any analyte present in the test sample, such that all analyte that is present in the test sample is bound by the first specific binding partner.

After any unbound analyte is removed, a second specific binding partner is added to the mixture to form a first specific binding partner-analyte-second specific binding partner complex. The second specific binding partner is preferably an anti-analyte antibody that binds to an epitope on analyte that differs from the epitope on analyte bound by the first specific binding partner. Moreover, also preferably, the second specific binding partner is labeled with or contains a detectable label as described above. The second specific binding partner can be a DVD-binding protein (or a fragment, a variant, or a fragment of a variant thereof) as described herein.

Any suitable detectable label as is known in the art can be used. For example, the detectable label can be a radioactive label (such as $^{3}H$, $^{125}I$, $^{35}S$, $^{14}C$, $^{32}P$, and $^{33}P$), an enzymatic label (such as horseradish peroxidase, alkaline peroxidase, glucose 6-phosphate dehydrogenase, and the like), a chemiluminescent label (such as acridinium esters, thioesters, or sulfonamides; luminol, isoluminol, phenanthridinium esters, and the like), a fluorescent label (such as fluorescein (e.g., 5-fluorescein, 6-carboxyfluorescein, 3'6-carboxyfluorescein, 5(6)-carboxyfluorescein, 6-hexachloro-fluorescein, 6-tetrachlorofluorescein, fluorescein isothiocyanate, and the like)), rhodamine, phycobiliproteins, R-phycoerythrin, quantum dots (e.g., zinc sulfide-capped cadmium selenide), a thermometric label, or an immuno-polymerase chain reaction label. An introduction to labels, labeling procedures and detection of labels is found in Polak and Van Noorden, Introduction to Immunocytochemistry, $2^{nd}$ ed., Springer Verlag, N.Y. (1997), and in Haugland, Handbook of Fluorescent Probes and Research Chemicals (1996), which is a combined handbook and catalogue published by Molecular Probes, Inc., Eugene, Oreg. A fluorescent label can be used in FPIA (see, e.g., U.S. Pat. No. 5,593,896). An acridinium compound can be used as a detectable label in a homogeneous or heterogeneous chemiluminescent assay (see, e.g., Adamczyk et al. (2006) Bioorg. Med. Chem. Lett. 16: 1324-1328).

A preferred acridinium compound is an acridinium-9-carboxamide. Methods for preparing acridinium 9-carboxamides are described in e.g. Mattingly (1991) J. Biolumin. Chemilumin. 6: 107-114. Another preferred acridinium compound is an acridinium-9-carboxylate aryl ester. An example of an acridinium-9-carboxylate aryl ester is 10-methyl-9-(phenoxycarbonyl)acridinium fluorosulfonate (available from Cayman Chemical, Ann Arbor, Mich.). Methods for preparing acridinium 9-carboxylate aryl esters are described in e.g. McCapra et al. (1965) Photochem. Photobiol. 4: 1111-21. Further details regarding acridinium-9-carboxylate aryl ester and its use are set forth in US Patent Publication No. 20080248493.

Chemiluminescent assays (e.g., using acridinium as described above or other chemiluminescent agents) can be performed in accordance with the methods described in Adamczyk et al. (2006) Anal. Chim Acta 579(1): 61-67. While any suitable assay format can be used, a microplate chemiluminometer (Mithras LB-940, Berthold Technologies U.S.A., LLC, Oak Ridge, Tenn.) enables the assay of multiple samples of small volumes rapidly.

The order in which the test sample and the specific binding partner(s) are added to form the mixture for chemiluminescent assay is not critical. If the first specific binding partner is detectably labeled with a chemiluminescent agent such as an acridinium compound, detectably labeled first specific binding partner-analyte complexes form. Alternatively, if a second specific binding partner is used and the second specific binding partner is detectably labeled with a chemiluminescent agent such as an acridinium compound, detectably labeled first specific binding partner-analyte-second specific binding partner complexes form. Any unbound specific binding partner, whether labeled or unlabeled, can be removed from the mixture using any technique known in the art, such as washing.

Hydrogen peroxide can be generated in situ in the mixture or provided or supplied to the mixture (e.g., the source of the hydrogen peroxide being one or more buffers or other solutions that are known to contain hydrogen peroxide) before, simultaneously with, or after the addition of an above-described acridinium compound. Hydrogen peroxide can be generated in situ in a number of ways such as would be apparent to one skilled in the art.

Upon the simultaneous or subsequent addition of at least one basic solution to the sample, a detectable signal, namely, a chemiluminescent signal, indicative of the presence of analyte is generated. The basic solution contains at least one base and has a pH greater than or equal to 10, preferably, greater than or equal to 12. Examples of basic solutions include, but are not limited to, sodium hydroxide, potassium hydroxide, calcium hydroxide, ammonium hydroxide, magnesium hydroxide, sodium carbonate, sodium bicarbonate, calcium hydroxide, calcium carbonate, and calcium bicarbonate. The amount of basic solution added to the sample depends on the concentration of the basic solution. Based on the concentration of the basic solution used, one skilled in the art can easily determine the amount of basic solution to add to the sample.

The chemiluminescent signal that is generated can be detected using routine techniques known to those skilled in the art. Based on the intensity of the signal generated, the amount of analyte in the sample can be quantified. Specifically, the amount of analyte in the sample is proportional to the intensity of the signal generated. The amount of analyte present can be quantified by comparing the amount of light generated to a standard curve for analyte or by comparison to a reference standard. The standard curve can be generated using serial dilutions or solutions of known concentrations of analyte by mass spectroscopy, gravimetric methods, and other techniques known in the art. While the above is described with emphasis on use of an acridinium compound as the chemiluminescent agent, one of ordinary skill in the art can readily adapt this description for use of other chemiluminescent agents.

Analyte immunoassays generally can be conducted using any format known in the art, such as, but not limited to, a sandwich format. Specifically, in one immunoassay format, at least two antibodies are employed to separate and quantify analyte, such as human analyte, or a fragment thereof in a sample. More specifically, the at least two antibodies bind to different epitopes on an analyte (or a fragment thereof) forming an immune complex, which is referred to as a "sandwich." Generally, in the immunoassays one or more antibodies can be used to capture the analyte (or a fragment thereof) in the test sample (these antibodies are frequently referred to as a "capture" antibody or "capture" antibodies) and one or more antibodies can be used to bind a detectable (namely, quantifiable) label to the sandwich (these antibodies are frequently referred to as the "detection antibody," the "detection antibodies," the "conjugate," or the "conjugates"). Thus, in the context of a sandwich immunoassay format, a binding protein or a DVD-binding protein (or a fragment, a variant, or a fragment of a variant thereof) as described herein can be used as a capture antibody, a detection antibody, or both. For example, one binding protein or DVD-binding protein having a domain that can bind a first epitope on an analyte (or a fragment thereof) can be used as a capture agent and/or another binding protein or DVD-binding protein having a domain that can bind a second epitope on an analyte (or a fragment thereof) can be used as a detection agent. In this regard, a binding protein or a DVD-binding protein having a first domain that can bind a first epitope on an analyte (or a fragment thereof) and a second domain that can bind a second epitope on an analyte (or a fragment thereof) can be used as a capture agent and/or a detection agent. Alternatively, one binding protein or DVD-binding protein having a first domain that can bind an epitope on a first analyte (or a fragment thereof) and a second domain that can bind an epitope on a second analyte (or a fragment thereof) can be used as a capture agent and/or a detection agent to detect, and optionally quantify, two or more analytes. In the event that an analyte can be present in a sample in more than one form, such as a monomeric form and a dimeric/multimeric form, which can be homomeric or heteromeric, one binding protein or DVD-binding protein having a domain that can bind an epitope that is only exposed on the monomeric form and another binding protein or DVD-binding protein having a domain that can bind an epitope on a different part of a dimeric/multimeric form can be used as capture agents and/or detection agents, thereby enabling the detection, and optional quantification, of different forms of a given analyte. Furthermore, employing binding proteins or DVD-binding proteins with differential affinities within a single binding protein or DVD-binding protein and/or between binding proteins or DVD-binding proteins can provide an avidity advantage. In the context of immunoassays as described herein, it generally may be helpful or desired to incorporate one or more linkers within the structure of a binding protein or a DVD-binding protein. When present, optimally the linker may be of sufficient length and structural flexibility to enable binding of an epitope by the inner domains as well as binding of another epitope by the outer domains. In this regard, when a binding protein or a DVD-binding protein can bind two different analytes and one analyte is larger than the other, desirably the larger analyte is bound by the outer domains.

Generally speaking, a sample being tested for (for example, suspected of containing) analyte (or a fragment thereof) can be contacted with at least one capture agent (or agent) and at least one detection agent (which can be a second detection agent or a third detection agent or even a successively numbered agent, e.g., as where the capture and/or detection agent comprises multiple agents) either simultaneously or sequentially and in any order. For example, the test sample can be first contacted with at least one capture agent and then (sequentially) with at least one detection agent. Alternatively, the test sample can be first contacted with at least one detection agent and then (sequentially) with at least one capture agent. In yet another alternative, the test sample can be contacted simultaneously with a capture agent and a detection agent.

In the sandwich assay format, a sample suspected of containing analyte (or a fragment thereof) is first brought into contact with at least one first capture agent under conditions that allow the formation of a first agent/analyte complex. If more than one capture agent is used, a first capture agent/analyte complex comprising two or more capture agents is formed. In a sandwich assay, the agents, i.e., preferably, the at least one capture agent, are used in molar excess amounts of the maximum amount of analyte (or a fragment thereof) expected in the test sample. For example, from about 5 µg to about 1 mg of agent per mL of buffer (e.g., microparticle coating buffer) can be used.

Competitive inhibition immunoassays, which are often used to measure small analytes because binding by only one antibody (i.e., a binding protein and/or a DVD-binding protein in the context of the present disclosure) is required, comprise sequential and classic formats. In a sequential competitive inhibition immunoassay a capture agent to an analyte of interest is coated onto a well of a microtiter plate or other solid support. When the sample containing the analyte of interest is added to the well, the analyte of interest binds to the capture agent. After washing, a known amount of labeled (e.g., biotin or horseradish peroxidase (HRP)) analyte capable of binding the capture antibody is added to the well. A substrate for an enzymatic label is used to generate a signal. An example of a suitable substrate for HRP is 3,3',5,5'-tetramethylbenzidine (TMB). After washing, the signal generated by the labeled analyte is measured and is inversely proportional to the amount of analyte in the sample. In a classic competitive inhibition immunoassay typically an antibody (i.e., binding protein and/or a DVD-binding protein in the context of the present disclosure) to an analyte of interest is coated onto a solid support (e.g., a well of a microtiter plate). However, unlike the sequential competitive inhibition immunoassay, the sample and the labeled analyte are added to the well at the same time. Any analyte in the sample competes with labeled analyte for binding to the capture agent. After washing, the signal generated by the labeled analyte is measured and is inversely proportional to the amount of analyte in the sample. Of course, there are many variations of these formats, e.g., when binding to the solid support takes place, whether the format is one-step, two-step, delayed two-step, and the like, and these would be recognized by one of ordinary skill in the art.

Optionally, prior to contacting the test sample with the at least one capture agent (for example, the first capture agent), the at least one capture agent can be bound to a solid support, which facilitates the separation of the first agent/analyte (or a fragment thereof) complex from the test sample. The substrate to which the capture agent is bound can be any suitable solid support or solid phase that facilitates separation of the capture agent-analyte complex from the sample.

Examples include a well of a plate, such as a microtiter plate, a test tube, a porous gel (e.g., silica gel, agarose, dextran, or gelatin), a polymeric film (e.g., polyacrylamide), beads (e.g., polystyrene beads or magnetic beads), a strip of a filter/membrane (e.g., nitrocellulose or nylon), microparticles (e.g., latex particles, magnetizable microparticles (e.g., microparticles having ferric oxide or chromium oxide cores and homo- or hetero-polymeric coats and radii of about 1-10 microns). The substrate can comprise a suitable porous material with a suitable surface affinity to bind antigens and sufficient porosity to allow access by detection antibodies. A microporous material is generally preferred, although a gelatinous material in a hydrated state can be used. Such porous substrates are preferably in the form of sheets having a thickness of about 0.01 to about 0.5 mm, preferably about 0.1 mm. While the pore size may vary quite a bit, preferably the pore size is from about 0.025 to about 15 microns, more preferably from about 0.15 to about 15 microns. The surface of such substrates can be passively coated or activated by chemical processes that cause covalent linkage of an antibody to the substrate. Irreversible binding, generally by adsorption through hydrophobic forces, of the antigen or the antibody to the substrate results; alternatively, a chemical coupling agent or other means can be used to bind covalently the antibody to the substrate, provided that such binding does not interfere with the ability of the antibody to bind to analyte. Alternatively, the antibody (i.e., binding proteins and/or DVD-binding proteins in the context of the present disclosure) can be bound with microparticles, which have been previously coated with streptavidin (e.g., DYNAL® Magnetic Beads, Invitrogen, Carlsbad, Calif.) or biotin (e.g., using Power-Bind™-SA-MP streptavidin-coated microparticles (Seradyn, Indianapolis, Ind.)) or anti-species-specific monoclonal antibodies (i.e., binding proteins and/or DVD-binding proteins in the context of the present disclosure). If necessary or desired, the substrate (e.g., for the label) can be derivatized to allow reactivity with various functional groups on the antibody (i.e., binding proteins and/or DVD-binding proteins in the context of the present disclosure). Such derivatization requires the use of certain coupling agents, examples of which include, but are not limited to, maleic anhydride, N-hydroxysuccinimide, and 1-ethyl-3-(3-dimethylaminopropyl) carbodiimide. If desired, one or more capture agents, such as antibodies (or fragments thereof) (i.e., binding proteins and/or DVD-binding proteins in the context of the present disclosure, each of which is specific for analyte(s) can be attached to solid phases in different physical or addressable locations (e.g., such as in a biochip configuration (see, e.g., U.S. Pat. No. 6,225,047; PCT Publication No. WO 99/51773; U.S. Pat. No. 6,329,209; PCT Publication No. WO 00/56934, and U.S. Pat. No. 5,242,828). If the capture agent is attached to a mass spectrometry probe as the solid support, the amount of analyte bound to the probe can be detected by laser desorption ionization mass spectrometry. Alternatively, a single column can be packed with different beads, which are derivatized with the one or more capture agents, thereby capturing the analyte in a single place (see, antibody-derivatized, bead-based technologies, e.g., the xMAP technology of Luminex (Austin, Tex.)).

After the test sample being assayed for analyte (or a fragment thereof) is brought into contact with the at least one capture agent (for example, the first capture agent), the mixture is incubated in order to allow for the formation of a first capture agent (or multiple capture agent)-analyte (or a fragment thereof) complex. The incubation can be carried out at a pH of from about 4.5 to about 10.0, at a temperature of from about 2° C. to about 45° C., and for a period from at least about one (1) minute to about eighteen (18) hours, preferably from about 1 to about 24 minutes, most preferably for about 4 to about 18 minutes. The immunoassay described herein can be conducted in one step (meaning the test sample, at least one capture agent and at least one detection agent are all added sequentially or simultaneously to a reaction vessel) or in more than one step, such as two steps, three steps, etc.

After formation of the (first or multiple) capture agent/analyte (or a fragment thereof) complex, the complex is then contacted with at least one detection agent under conditions which allow for the formation of a (first or multiple) capture agent/analyte (or a fragment thereof)/second detection agent complex). While captioned for clarity as the "second" agent (e.g., second detection agent), in fact, where multiple agent are used for capture and/or detection, the at least one detection agent can be the second, third, fourth, etc. agents used in the immunoassay. If the capture agent/analyte (or a fragment thereof) complex is contacted with more than one detection agent, then a (first or multiple) capture agent/analyte (or a fragment thereof)/(multiple) detection agent complex is formed. As with the capture agent (e.g., the first capture agent), when the at least one (e.g., second and any subsequent) detection agent is brought into contact with the capture agent/analyte (or a fragment thereof) complex, a period of incubation under conditions similar to those described above is required for the formation of the (first or multiple) capture agent/analyte (or a fragment thereof)/(second or multiple) detection agent complex. Preferably, at least one detection agent contains a detectable label. The detectable label can be bound to the at least one detection agent (e.g., the second detection agent) prior to, simultaneously with, or after the formation of the (first or multiple) capture agent/analyte (or a fragment thereof)/(second or multiple) detection agent complex. Any detectable label known in the art can be used (see discussion above, including of the Polak and Van Noorden (1997) and Haugland (1996) references).

The detectable label can be bound to the antibodies either directly or through a coupling agent. An example of a coupling agent that can be used is EDAC (1-ethyl-3-(3-dimethylaminopropyl) carbodiimide, hydrochloride), which is commercially available from Sigma-Aldrich, St. Louis, Mo. Other coupling agents that can be used are known in the art. Methods for binding a detectable label to an antibody are known in the art. Additionally, many detectable labels can be purchased or synthesized that already contain end groups that facilitate the coupling of the detectable label to the agent, such as CPSP-Acridinium Ester (i.e., 9-[N-tosyl-N-(3-carboxypropyl)]-10-(3-sulfopropyl)acridinium carboxamide) or SPSP-Acridinium Ester (i.e., N10-(3-sulfopropyl)-N-(3-sulfopropyl)-acridinium-9-carboxamide).

The (first or multiple) capture agent/analyte/(second or multiple) detection agent complex can be, but does not have to be, separated from the remainder of the test sample prior to quantification of the label. For example, if the at least one capture agent (e.g., the first capture agent, such as a binding protein and/or a DVD-binding protein in accordance with the present disclosure) is bound to a solid support, such as a well or a bead, separation can be accomplished by removing the fluid (of the test sample) from contact with the solid support. Alternatively, if the at least first capture agent is bound to a solid support, it can be simultaneously contacted with the analyte-containing sample and the at least one second detection agent to form a first (multiple) agent/analyte/second (multiple) agent complex, followed by removal of the fluid (test sample) from contact with the solid support. If the at least one first capture agent is not bound to a solid support, then the (first or multiple) capture agent/analyte/(second or multiple) detection agent complex does not have to be removed from the test sample for quantification of the amount of the label.

After formation of the labeled capture agent/analyte/detection agent complex (e.g., the first capture agent/analyte/second detection agent complex), the amount of label in the complex is quantified using techniques known in the art. For example, if an enzymatic label is used, the labeled complex is reacted with a substrate for the label that gives a quantifiable reaction such as the development of color. If the label is a radioactive label, the label is quantified using appropriate means, such as a scintillation counter. If the label is a fluorescent label, the label is quantified by stimulating the label with a light of one color (which is known as the "excitation wavelength") and detecting another color (which is known as the "emission wavelength") that is emitted by the label in response to the stimulation. If the label is a chemiluminescent label, the label is quantified by detecting the light emitted either visually or by using luminometers, x-ray film, high speed photographic film, a CCD camera, etc. Once the amount of the label in the complex has been quantified, the concentration of analyte or a fragment thereof in the test sample is determined by appropriate means, such as by use of a standard curve that has been generated using serial dilutions of analyte or a fragment thereof of known concentration. Other than using serial dilutions of analyte or a fragment thereof, the standard curve can be generated gravimetrically, by mass spectroscopy and by other techniques known in the art.

In a chemiluminescent microparticle assay employing the ARCHITECT® analyzer, the conjugate diluent pH may be about 6.0+/−0.2, the microparticle coating buffer may be maintained at about room temperature (i.e., at from about 17 to about 27° C.), the microparticle coating buffer pH may be about 6.5+/−0.2, and the microparticle diluent pH may be about 7.8+/−0.2. Solids preferably are less than about 0.2%, such as less than about 0.15%, less than about 0.14%, less than about 0.13%, less than about 0.12%, or less than about 0.11%, such as about 0.10%.

FPIAs are based on competitive binding immunoassay principles. A fluorescently labeled compound, when excited by a linearly polarized light, will emit fluorescence having a degree of polarization inversely proportional to its rate of rotation. When a fluorescently labeled tracer-antibody complex is excited by a linearly polarized light, the emitted light remains highly polarized because the fluorophore is constrained from rotating between the time light is absorbed and the time light is emitted. When a "free" tracer compound (i.e., a compound that is not bound to an antibody) is excited by linearly polarized light, its rotation is much faster than the corresponding tracer-antibody conjugate (or tracer-binding protein and/or tracer-DVD-binding protein in accordance with the present disclosure) produced in a competitive binding immunoassay. FPIAs are advantageous over RIAs inasmuch as there are no radioactive substances requiring special handling and disposal. In addition, FPIAs are homogeneous assays that can be easily and rapidly performed.

In view of the above, a method of determining the presence, amount, or concentration of analyte (or a fragment thereof) in a test sample is provided. The method comprises assaying the test sample for an analyte (or a fragment thereof) by an assay (i) employing (i') at least one of an antibody, a fragment of an antibody that can bind to an analyte, a variant of an antibody that can bind to an analyte, a fragment of a variant of an antibody that can bind to an analyte, a binding protein as disclosed herein, and a DVD-binding protein (or a fragment, a variant, or a fragment of a variant thereof) that can bind to an analyte, and (ii') at least one detectable label and (ii) comprising comparing a signal generated by the detectable label as a direct or indirect indication of the presence, amount or concentration of analyte (or a fragment thereof) in the test sample to a signal generated as a direct or indirect indication of the presence, amount or concentration of analyte (or a fragment thereof) in a control or calibrator. The calibrator is optionally part of a series of calibrators, in which each of the calibrators differs from the other calibrators by the concentration of analyte.

The method can comprise (i) contacting the test sample with at least one first specific binding partner for analyte (or a fragment thereof) comprising an antibody, a fragment of an antibody that can bind to an analyte, a variant of an antibody that can bind to an analyte, a fragment of a variant of an antibody that can bind to an analyte, a binding protein as disclosed herein, or a DVD-binding protein (or a fragment, a variant, or a fragment of a variant thereof) that can bind to an analyte so as to form a first specific binding partner/analyte (or fragment thereof) complex, (ii) contacting the first specific binding partner/analyte (or fragment thereof) complex with at least one second specific binding partner for analyte (or fragment thereof) comprising a detectably labeled anti-analyte antibody, a detectably labeled fragment of an anti-analyte antibody that can bind to analyte, a detectably labeled variant of an anti-analyte antibody that can bind to analyte, a detectably labeled fragment of a variant of an anti-analyte antibody that can bind to analyte, a detectably labeled binding protein as disclosed herein that can bind to analyte, or a detectably labeled DVD-binding protein (or a fragment, a variant, or a fragment of a variant thereof) so as to form a first specific binding partner/analyte (or fragment thereof)/second specific binding partner complex, and (iii) determining the presence, amount or concentration of analyte in the test sample by detecting or measuring the signal generated by the detectable label in the first specific binding partner/analyte (or fragment thereof)/second specific binding partner complex formed in (ii). A method in which at least one first specific binding partner for analyte (or a fragment thereof) and/or at least one second specific binding partner for analyte (or a fragment thereof) is a binding protein as disclosed herein or a DVD-binding protein (or a fragment, a variant, or a fragment of a variant thereof) as described herein can be preferred.

Alternatively, the method can comprise contacting the test sample with at least one first specific binding partner for analyte (or a fragment thereof) comprising an antibody, a fragment of an antibody that can bind to an analyte, a variant of an antibody that can bind to an analyte, a fragment of a variant of an antibody that can bind to an analyte, a binding protein as disclosed herein, and a DVD-binding protein (or a fragment, a variant, or a fragment of a variant thereof) and simultaneously or sequentially, in either order, contacting the test sample with at least one second specific binding partner, which can compete with analyte (or a fragment thereof) for binding to the at least one first specific binding partner and which comprises a detectably labeled analyte, a detectably labeled fragment of analyte that can bind to the first specific binding partner, a detectably labeled variant of analyte that can bind to the first specific binding partner, or a detectably labeled fragment of a variant of analyte that can bind to the first specific binding partner. Any analyte (or a fragment thereof) present in the test sample and the at least one second specific binding partner compete with each other to form a first specific binding partner/analyte (or fragment thereof) complex and a first specific binding partner/second specific binding partner complex, respectively. The method further comprises determining the presence, amount or concentration of analyte in the test sample by detecting or measuring the signal generated by the detectable label in the first specific binding partner/second specific binding partner complex formed in (ii), wherein the signal generated by the detectable label in the first specific binding partner/second specific binding partner complex is inversely proportional to the amount or concentration of analyte in the test sample.

The above methods can further comprise diagnosing, prognosticating, or assessing the efficacy of a therapeutic/prophylactic treatment of a patient from whom the test sample was obtained. If the method further comprises assessing the efficacy of a therapeutic/prophylactic treatment of the patient from whom the test sample was obtained, the method optionally further comprises modifying the therapeutic/prophylactic treatment of the patient as needed to improve efficacy. The method can be adapted for use in an automated system or a semi-automated system.

With regard to the methods of assay (and kit therefor), it may be possible to employ commercially available anti-analyte antibodies or methods for production of anti-analyte as described in the literature. Commercial supplies of various antibodies include, but are not limited to, Santa Cruz Biotechnology Inc. (Santa Cruz, Calif.), GenWay Biotech, Inc. (San Diego, Calif.), and R&D Systems (RDS; Minneapolis, Minn.).

Generally, a predetermined level can be employed as a benchmark against which to assess results obtained upon assaying a test sample for analyte or a fragment thereof, e.g., for detecting disease or risk of disease. Generally, in making such a comparison, the predetermined level is obtained by running a particular assay a sufficient number of times and under appropriate conditions such that a linkage or association of analyte presence, amount or concentration with a particular stage or endpoint of a disease, disorder or condition or with particular clinical indicia can be made. Typically, the predetermined level is obtained with assays of reference subjects (or populations of subjects). The analyte measured can include fragments thereof, degradation products thereof, and/or enzymatic cleavage products thereof.

In particular, with respect to a predetermined level as employed for monitoring disease progression and/or treatment, the amount or concentration of analyte or a fragment thereof may be "unchanged," "favorable" (or "favorably altered"), or "unfavorable" (or "unfavorably altered"). "Elevated" or "increased" refers to an amount or a concentration in a test sample that is higher than a typical or normal level or range (e.g., predetermined level), or is higher than another reference level or range (e.g., earlier or baseline sample). The term "lowered" or "reduced" refers to an amount or a concentration in a test sample that is lower than a typical or normal level or range (e.g., predetermined level), or is lower than another reference level or range (e.g., earlier or baseline sample). The term "altered" refers to an amount or a concentration in a sample that is altered (increased or decreased) over a typical or normal level or range (e.g., predetermined level), or over another reference level or range (e.g., earlier or baseline sample).

The typical or normal level or range for analyte is defined in accordance with standard practice. Because the levels of analyte in some instances will be very low, a so-called altered level or alteration can be considered to have occurred when there is any net change as compared to the typical or normal level or range, or reference level or range, that cannot be explained by experimental error or sample variation. Thus, the level measured in a particular sample will be compared with the level or range of levels determined in similar samples from a so-called normal subject. In this context, a "normal subject" is an individual with no detectable disease, for example, and a "normal" (sometimes termed "control") patient or population is/are one(s) that exhibit(s) no detectable disease, respectively, for example. Furthermore, given that analyte is not routinely found at a high level in the majority of the human population, a "normal subject" can be considered an individual with no substantial detectable increased or elevated amount or concentration of analyte, and a "normal" (sometimes termed "control") patient or population is/are one(s) that exhibit(s) no substantial detectable increased or elevated amount or concentration of analyte. An "apparently normal subject" is one in which analyte has not yet been or currently is being assessed. The level of an analyte is "elevated" when the analyte is normally undetectable (e.g., the normal level is zero, or within a range of from about 25 to about 75 percentiles of normal populations), but is detected in a test sample, as well as when the analyte is present in the test sample at a higher than normal level. Thus, inter alia, the disclosure provides a method of screening for a subject having, or at risk of having, a particular disease, disorder, or condition. The method of assay can also involve the assay of other markers and the like.

Accordingly, the methods described herein also can be used to determine whether or not a subject has or is at risk of developing a given disease, disorder or condition. Specifically, such a method can comprise the steps of:

(a) determining the concentration or amount in a test sample from a subject of analyte (or a fragment thereof) (e.g., using the methods described herein, or methods known in the art); and (b) comparing the concentration or amount of analyte (or a fragment thereof) determined in step (a) with a predetermined level, wherein, if the concentration or amount of analyte determined in step (a) is favorable with respect to a predetermined level, then the subject is determined not to have or be at risk for a given disease, disorder or condition. However, if the concentration or amount of analyte determined in step (a) is unfavorable with respect to the predetermined level, then the subject is determined to have or be at risk for a given disease, disorder or condition.

Additionally, provided herein is method of monitoring the progression of disease in a subject. Optimally the method comprising the steps of:

(a) determining the concentration or amount in a test sample from a subject of analyte;

(b) determining the concentration or amount in a later test sample from the subject of analyte; and (c) comparing the concentration or amount of analyte as determined in step (b) with the concentration or amount of analyte determined in step (a), wherein if the concentration or amount determined in step (b) is unchanged or is unfavorable when compared to the concentration or amount of analyte determined in step (a), then the disease in the subject is determined to have continued, progressed or worsened. By comparison, if the concentration or amount of analyte as determined in step (b) is favorable when compared to the concentration or amount of analyte as determined in step (a), then the disease in the subject is determined to have discontinued, regressed or improved.

Optionally, the method further comprises comparing the concentration or amount of analyte as determined in step (b), for example, with a predetermined level. Further, optionally the method comprises treating the subject with one or more pharmaceutical compositions for a period of time if the comparison shows that the concentration or amount of analyte as determined in step (b), for example, is unfavorably altered with respect to the predetermined level.

Still further, the methods can be used to monitor treatment in a subject receiving treatment with one or more pharmaceutical compositions. Specifically, such methods involve providing a first test sample from a subject before the subject has been administered one or more pharmaceutical compositions. Next, the concentration or amount in a first test sample from a subject of analyte is determined (e.g., using the methods described herein or as known in the art). After the concentration or amount of analyte is determined, optionally the concentration or amount of analyte is then compared with a predetermined level. If the concentration or amount of analyte as determined in the first test sample is lower than the predetermined level, then the subject is not treated with one or more pharmaceutical compositions. However, if the concentration or amount of analyte as determined in the first test sample is higher than the predetermined level, then the subject is treated with one or more pharmaceutical compositions for a period of time. The period of time that the subject is treated with the one or more pharmaceutical compositions can be determined by one skilled in the art (for example, the period of time can be from about seven (7) days to about two years, preferably from about fourteen (14) days to about one (1) year).

During the course of treatment with the one or more pharmaceutical compositions, second and subsequent test samples are then obtained from the subject. The number of test samples and the time in which the test samples are obtained from the subject are not critical. For example, a second test sample could be obtained seven (7) days after the subject is first administered the one or more pharmaceutical compositions, a third test sample could be obtained two (2) weeks after the subject is first administered the one or more pharmaceutical compositions, a fourth test sample could be obtained three (3) weeks after the subject is first administered the one or more pharmaceutical compositions, a fifth test sample could be obtained four (4) weeks after the subject is first administered the one or more pharmaceutical compositions, etc.

After each second or subsequent test sample is obtained from the subject, the concentration or amount of analyte is determined in the second or subsequent test sample is determined (e.g., using the methods described herein or as known in the art). The concentration or amount of analyte as determined in each of the second and subsequent test samples is then compared with the concentration or amount of analyte as determined in the first test sample (e.g., the test sample that was originally optionally compared to the predetermined level). If the concentration or amount of analyte as determined in step (c) is favorable when compared to the concentration or amount of analyte as determined in step (a), then the disease in the subject is determined to have discontinued, regressed or improved, and the subject may continue to be administered the one or pharmaceutical compositions of step (b). However, if the concentration or amount determined in step (c) is unchanged or is unfavorable when compared to the concentration or amount of analyte as determined in step (a), then the disease in the subject is determined to have continued, progressed or worsened, and the subject may be treated with a higher concentration of the one or more pharmaceutical compositions administered to the subject in step (b) or the subject may be treated with one or more pharmaceutical compositions that are different from the one or more pharmaceutical compositions administered to the subject in step (b). Specifically, the subject can be treated with one or more pharmaceutical compositions that are different from the one or more pharmaceutical compositions that the subject had previously received to decrease or lower the subject's analyte level.

Generally, for assays in which repeat testing may be done (e.g., monitoring disease progression and/or response to treatment), a second or subsequent test sample is obtained at a period in time after the first test sample has been obtained from the subject. Specifically, a second test sample from the subject can be obtained minutes, hours, days, weeks or years after the first test sample has been obtained from the subject. For example, the second test sample can be obtained from the subject at a time period of about 1 minute, about 5 minutes, about 10 minutes, about 15 minutes, about 30 minutes, about 45 minutes, about 60 minutes, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days, about 7 days, about 2 weeks, about 3 weeks, about 4 weeks, about 5 weeks, about 6 weeks, about 7 weeks, about 8 weeks, about 9 weeks, about 10 weeks, about 11 weeks, about 12 weeks, about 13 weeks, about 14 weeks, about 15 weeks, about 16 weeks, about 17 weeks, about 18 weeks, about 19 weeks, about 20 weeks, about 21 weeks, about 22 weeks, about 23 weeks, about 24 weeks, about 25 weeks, about 26 weeks, about 27 weeks, about 28 weeks, about 29 weeks, about 30 weeks, about 31 weeks, about 32 weeks, about 33 weeks, about 34 weeks, about 35 weeks, about 36 weeks, about 37 weeks, about 38 weeks, about 39 weeks, about 40 weeks, about 41 weeks, about 42 weeks, about 43 weeks, about 44 weeks, about 45 weeks, about 46 weeks, about 47 weeks, about 48 weeks, about 49 weeks, about 50 weeks, about 51 weeks, about 52 weeks, about 1.5 years, about 2 years, about 2.5 years, about 3.0 years, about 3.5 years, about 4.0 years, about 4.5 years, about 5.0 years, about 5.5. years, about 6.0 years, about 6.5 years, about 7.0 years, about 7.5 years, about 8.0 years, about 8.5 years, about 9.0 years, about 9.5 years or about 10.0 years after the first test sample from the subject is obtained.

When used to monitor disease progression, the above assay can be used to monitor the progression of disease in subjects suffering from acute conditions. Acute conditions, also known as critical care conditions, refer to acute, life-threatening diseases or other critical medical conditions involving, for example, the cardiovascular system or excretory system. Typically, critical care conditions refer to those conditions requiring acute medical intervention in a hospital-based setting (including, but not limited to, the emergency room, intensive care unit, trauma center, or other emergent care setting) or administration by a paramedic or other field-based medical personnel. For critical care conditions, repeat monitoring is generally done within a shorter time frame, namely, minutes, hours or days (e.g., about 1 minute, about 5 minutes, about 10 minutes, about 15 minutes, about 30 minutes, about 45 minutes, about 60 minutes, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days or about 7 days), and the initial assay likewise is generally done within a shorter timeframe, e.g., about minutes, hours or days of the onset of the disease or condition.

The assays also can be used to monitor the progression of disease in subjects suffering from chronic or non-acute conditions. Non-critical care or, non-acute conditions, refers to conditions other than acute, life-threatening disease or other critical medical conditions involving, for example, the cardiovascular system and/or excretory system. Typically, non-acute conditions include those of longer-term or chronic duration. For non-acute conditions, repeat monitoring generally is done with a longer timeframe, e.g., hours, days, weeks, months or years (e.g., about 1 hour, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days, about 7 days, about 2 weeks, about 3 weeks, about 4 weeks, about 5 weeks, about 6 weeks, about 7 weeks, about 8 weeks, about 9 weeks, about 10 weeks, about 11 weeks, about 12 weeks, about 13 weeks, about 14 weeks, about 15 weeks, about 16 weeks, about 17 weeks, about 18 weeks, about 19 weeks, about 20 weeks, about 21 weeks, about 22 weeks, about 23 weeks, about 24 weeks, about 25 weeks, about 26 weeks, about 27 weeks, about 28 weeks, about 29 weeks, about 30 weeks, about 31 weeks, about 32 weeks, about 33 weeks, about 34 weeks, about 35 weeks, about 36 weeks, about 37 weeks, about 38 weeks, about 39 weeks, about 40 weeks, about 41 weeks, about 42 weeks, about 43 weeks, about 44 weeks, about 45 weeks, about 46 weeks, about 47 weeks, about 48 weeks, about 49 weeks, about 50 weeks, about 51 weeks, about 52 weeks, about 1.5 years, about 2 years, about 2.5 years, about 3.0 years, about 3.5 years, about 4.0 years, about 4.5 years, about 5.0 years, about 5.5. years, about 6.0 years, about 6.5 years, about 7.0 years, about 7.5 years, about 8.0 years, about 8.5 years, about 9.0 years, about 9.5 years or about 10.0 years), and the initial assay likewise generally is done within a longer time frame, e.g., about hours, days, months or years of the onset of the disease or condition.

Furthermore, the above assays can be performed using a first test sample obtained from a subject where the first test sample is obtained from one source, such as urine, serum or plasma. Optionally, the above assays can then be repeated using a second test sample obtained from the subject where the second test sample is obtained from another source. For example, if the first test sample was obtained from urine, the second test sample can be obtained from serum or plasma. The results obtained from the assays using the first test sample and the second test sample can be compared. The comparison can be used to assess the status of a disease or condition in the subject.

Moreover, the present disclosure also relates to methods of determining whether a subject predisposed to or suffering from a given disease, disorder or condition will benefit from treatment. In particular, the disclosure relates to analyte companion diagnostic methods and products. Thus, the method of "monitoring the treatment of disease in a subject" as described herein further optimally also can encompass selecting or identifying candidates for therapy.

Thus, in particular embodiments, the disclosure also provides a method of determining whether a subject having, or at risk for, a given disease, disorder or condition is a candidate for therapy. Generally, the subject is one who has experienced some symptom of a given disease, disorder or condition or who has actually been diagnosed as having, or being at risk for, a given disease, disorder or condition, and/or who demonstrates an unfavorable concentration or amount of analyte or a fragment thereof, as described herein.

The method optionally comprises an assay as described herein, where analyte is assessed before and following treatment of a subject with one or more pharmaceutical compositions (e.g., particularly with a pharmaceutical related to a mechanism of action involving analyte), with immunosuppressive therapy, or by immunoabsorption therapy, or where analyte is assessed following such treatment and the concentration or the amount of analyte is compared against a predetermined level. An unfavorable concentration of amount of analyte observed following treatment confirms that the subject will not benefit from receiving further or continued treatment, whereas a favorable concentration or amount of analyte observed following treatment confirms that the subject will benefit from receiving further or continued treatment. This confirmation assists with management of clinical studies, and provision of improved patient care.

It goes without saying that, while certain embodiments herein are advantageous when employed to assess a given disease, disorder or condition as discussed herein, the assays and kits can be employed to assess analyte in other diseases, disorders and conditions. The method of assay can also involve the assay of other markers and the like.

The method of assay also can be used to identify a compound that ameliorates a given disease, disorder or condition. For example, a cell that expresses analyte can be contacted with a candidate compound. The level of expression of analyte in the cell contacted with the compound can be compared to that in a control cell using the method of assay described herein.

VI) Kit

A kit for assaying a test sample for the presence, amount or concentration of an analyte (or a fragment thereof) in a test sample is also provided. The kit comprises at least one component for assaying the test sample for the analyte (or a fragment thereof) and instructions for assaying the test sample for the analyte (or a fragment thereof). The at least one component for assaying the test sample for the analyte (or a fragment thereof) can include a composition comprising a binding protein as disclosed herein and/or an anti-analyte DVD-binding protein (or a fragment, a variant, or a fragment of a variant thereof), which is optionally immobilized on a solid phase.

The kit can comprise at least one component for assaying the test sample for an analyte by immunoassay, e.g., chemiluminescent microparticle immunoassay, and instructions for assaying the test sample for an analyte by immunoassay, e.g., chemiluminescent microparticle immunoassay. For example, the kit can comprise at least one specific binding partner for an analyte, such as an anti-analyte, monoclonal/polyclonal antibody (or a fragment thereof that can bind to the analyte, a variant thereof that can bind to the analyte, or a fragment of a variant that can bind to the analyte), a binding protein as disclosed herein, or an anti-analyte DVD-binding protein (or a fragment, a variant, or a fragment of a variant thereof), either of which can be detectably labeled. Alternatively or additionally, the kit can comprise detectably labeled analyte (or a fragment thereof that can bind to an anti-analyte, monoclonal/polyclonal antibody, a binding protein as disclosed herein, or an anti-analyte DVD-binding protein (or a fragment, a variant, or a fragment of a variant thereof)), which can compete with any analyte in a test sample for binding to an anti-analyte, monoclonal/polyclonal antibody (or a fragment thereof that can bind to the analyte, a variant thereof that can bind to the analyte, or a fragment of a variant that can bind to the analyte), a binding protein as disclosed herein, or an anti-analyte DVD-binding protein (or a fragment, a variant, or a fragment of a variant thereof), either of which can be immobilized on a solid support. The kit can comprise a calibrator or control, e.g., isolated or purified analyte. The kit can comprise at least one container (e.g., tube, microtiter plates or strips, which can be already coated with a first specific binding partner, for example) for conducting the assay, and/or a buffer, such as an assay buffer or a wash buffer, either one of which can be provided as a concentrated solution, a substrate solution for the detectable label (e.g., an enzymatic label), or a stop solution. Preferably, the kit comprises all components, i.e., reagents, standards, buffers, diluents, etc., which are used to perform the assay. The instructions can be in paper form or computer-readable form, such as a disk, CD, DVD, or the like.

More specifically, provided is a kit for assaying a test sample for an antigen (or a fragment thereof). The kit comprises at least one component for assaying the test sample for an antigen (or a fragment thereof) and instructions for assaying the test sample for an antigen (or a fragment thereof), wherein the at least one component includes at least one composition comprising a binding protein, such as a DVD-binding protein, disclosed herein.

Any antibodies, such as an anti-analyte antibody, any binding protein as disclosed herein, any anti-analyte DVD-binding proteins, or tracers can incorporate a detectable label as described herein, such as a fluorophore, a radioactive moiety, an enzyme, a biotin/avidin label, a chromophore, a chemiluminescent label, or the like, or the kit can include reagents for carrying out detectable labeling. The antibodies, calibrators and/or controls can be provided in separate containers or pre-dispensed into an appropriate assay format, for example, into microtiter plates.

Optionally, the kit includes quality control components (for example, sensitivity panels, calibrators, and positive controls). Preparation of quality control reagents is well-known in the art and is described on insert sheets for a variety of immunodiagnostic products. Sensitivity panel members optionally are used to establish assay performance characteristics, and further optionally are useful indicators of the integrity of the immunoassay kit reagents, and the standardization of assays.

The kit can also optionally include other reagents required to conduct a diagnostic assay or facilitate quality control evaluations, such as buffers, salts, enzymes, enzyme co-factors, enzyme substrates, detection reagents, and the like. Other components, such as buffers and solutions for the isolation and/or treatment of a test sample (e.g., pretreatment reagents), also can be included in the kit. The kit can additionally include one or more other controls. One or more of the components of the kit can be lyophilized, in which case the kit can further comprise reagents suitable for the reconstitution of the lyophilized components.

The various components of the kit optionally are provided in suitable containers as necessary, e.g., a microtiter plate. The kit can further include containers for holding or storing a sample (e.g., a container or cartridge for a urine sample). Where appropriate, the kit optionally also can contain reaction vessels, mixing vessels, and other components that facilitate the preparation of reagents or the test sample. The kit can also include one or more instruments for assisting with obtaining a test sample, such as a syringe, pipette, forceps, measured spoon, or the like.

If the detectable label is at least one acridinium compound, the kit can comprise at least one acridinium-9-carboxamide, at least one acridinium-9-carboxylate aryl ester, or any combination thereof. If the detectable label is at least one acridinium compound, the kit also can comprise a source of hydrogen peroxide, such as a buffer, a solution, and/or at least one basic solution. If desired, the kit can contain a solid phase, such as a magnetic particle, bead, test tube, microtiter plate, cuvette, membrane, scaffolding molecule, film, filter paper, disc or chip.

A. Adaptation of Kit and Method

The kit (or components thereof), as well as the method of determining the presence, amount or concentration of an analyte in a test sample by an assay, such as an immunoassay as described herein, can be adapted for use in a variety of automated and semi-automated systems (including those wherein the solid phase comprises a microparticle), as described, e.g., in U.S. Pat. Nos. 5,089,424 and 5,006,309, and as commercially marketed, e.g., by Abbott Laboratories (Abbott Park, Ill.) as ARCHITECT®.

Some of the differences between an automated or semi-automated system as compared to a non-automated system (e.g., ELISA) include the substrate to which the first specific binding partner (e.g., an anti-analyte, monoclonal/polyclonal antibody (or a fragment thereof, a variant thereof, or a fragment of a variant thereof), a binding protein as disclosed herein, or an anti-analyte DVD-binding protein (or a fragment thereof, a variant thereof, or a fragment of a variant thereof) is attached; either way, sandwich formation and analyte reactivity can be impacted), and the length and timing of the capture, detection and/or any optional wash steps. Whereas a non-automated format, such as an ELISA, may require a relatively longer incubation time with sample and capture reagent (e.g., about 2 hours), an automated or semi-automated format (e.g., ARCHITECT®, Abbott Laboratories) may have a relatively shorter incubation time (e.g., approximately 18 minutes for ARCHITECT®). Similarly, whereas a non-automated format, such as an ELISA, may incubate a detection antibody, such as the conjugate reagent, for a relatively longer incubation time (e.g., about 2 hours), an automated or semi-automated format (e.g., ARCHITECT®) may have a relatively shorter incubation time (e.g., approximately 4 minutes for the ARCHITECT®).

Other platforms available from Abbott Laboratories include, but are not limited to, AxSYM®, IMx® (see, e.g., U.S. Pat. No. 5,294,404, PRISM®, EIA (bead), and Quantum™ II, as well as other platforms. Additionally, the assays, kits and kit components can be employed in other formats, for example, on electrochemical or other hand-held or point-of-care assay systems. The present disclosure is, for example, applicable to the commercial Abbott Point of Care (i-STAT®, Abbott Laboratories) electrochemical immunoassay system that performs sandwich immunoassays Immunosensors and their methods of manufacture and operation in single-use test devices are described, for example in, U.S. Pat. Nos. 5,063,081, 7,419,821; and 7,682,833; US Publication Nos. 20040018577 and 20060160164.

It further goes without saying that the methods and kits as described herein necessarily encompass other reagents and methods for carrying out the immunoassay. For instance, encompassed are various buffers such as are known in the art and/or which can be readily prepared or optimized to be employed, e.g., for washing, as a conjugate diluent, microparticle diluent, and/or as a calibrator diluent. An exemplary conjugate diluent is ARCHITECT® conjugate diluent employed in certain kits (Abbott Laboratories, Abbott Park, Ill.) and containing 2-(N-morpholino)ethanesulfonic acid (MES), a salt, a protein blocker, an antimicrobial agent, and a detergent. An exemplary calibrator diluent is ARCHITECT® human calibrator diluent employed in certain kits (Abbott Laboratories, Abbott Park, Ill.), which comprises a buffer containing MES, other salt, a protein blocker, and an antimicrobial agent. Additionally, as described in U.S. patent application No. 61/142,048 filed Dec. 31, 2008, improved signal generation may be obtained, e.g., in an I-Stat cartridge format, using a nucleic acid sequence linked to the signal antibody as a signal amplifier.

It will be readily apparent to those skilled in the art that other suitable modifications and adaptations of the methods described herein are obvious and may be made using suitable equivalents without departing from the scope of the embodiments disclosed herein. Having now described certain embodiments in detail, the same will be more clearly understood by reference to the following examples, which are included for purposes of illustration only and are not intended to be limiting.

EXAMPLES

Example 1

Preparation of Improved TNF-α Parental Binding Proteins

Example 1.1

Identification of Fully Human Binding Proteins to TNF by In Vitro Display Systems 1.1.1: Antibody Selections Fully human anti-human TNF monoclonal antibodies were isolated by in vitro display technologies from human antibody libraries by their ability to bind recombinant human TNF proteins. The amino acid sequences of the variable heavy (VH) and variable light (VL) chains were determined from DNA sequencing and listed in Table 1B in section A)I)A) above.

1.1.2: Affinity Maturation of the Fully Human Human TNF Binding Protein AE11-5

The AE11-5 human binding protein to human TNF was affinity matured by in vitro display technology. One light chain library was constructed to contain limited mutagenesis at the following residues: 28, 31, 32, 51, 55, 91, 92, 93, 95a and 96 (Kabat numbering). This library also contained framework germline back-mutations D1E, M4L, H11Q, R49K, $H_{76}N$ and Q103K as well as toggled residues at position 50(R/K) and 94(S/L) to allow for framework germlining during library selections. Two heavy chain libraries were made to contain limited mutagenesis in CDRH1 and CDRH2 at residues 30, 31, 33, 50, 52, and 55 to 58 (Kabat numbering) or in CDRH3 at residues 95 to 100b. The library containing CDRH1 and CDRH2 diversities also had framework germline back-mutations A18V and L64Q and toggled residue at 54(L/F) and 78(V/A). The CDRH3 library had an additional toggled residue at 100c(A/F).

All three libraries were selected separately for the ability to bind human or cynomolgus monkey TNF in the presence of decreasing concentrations of biotinylated human or cynomolgus monkey TNF antigens. All mutated CDR sequences recovered from library selections were recombined into additional libraries and the recombined libraries were subjected to more stringent selection conditions before individual antibodies are identified.

The table below (Table 2) provides a list of amino acid sequences of VH and VL of the fully human AE11-5 binding protein which were subjected to the affinity maturation selection protocol. Amino acid residues of individual CDRs of each VH and VL sequence are indicated in bold.

TABLE 2

Amino acid residues observed in affinity matured AE11-5 antibodies

AE11-5 Heavy chain variable region (SEQ ID NO: 805)

```
AE11-5VH 1234567890123456789012345678901234567890123456789012a345678901
         EVQLVQSGAEVKKPGSSAKVSCKASGGTFSSYAISWVRQAPGQGLEWMGGIIPILGTANYAQ
                       V           NW TTT             WT    FRSPI
                                   TY SV              M     TDAST
                                   GI  P              L    I NGS
                                   AN  G              V      P V
                                   F                  N      I H
                                   R                         V A
                                   L                         K R
                                                             F M
                                                             L
```

TABLE 2-continued

Amino acid residues observed in affinity matured AE11-5 antibodies

```
         23456789012345678901 2abc345678901234567890abc1234567890123
         KFLGRVTITADESTSTVYMELSSLRSEDTAVYYCARGLYYDPTRADYWGQGTLVTVSS
            Q              A              SVFFNTSWF
                                          WIVVEFASM
                                          TFP TRKP
                                          ARH IGRA
                                           Q  ADI
                                              Y
                                              V
                                              P
                                              N
                                              G
```

AE11-5 Light chain variable region (SEQ ID NO: 806)

```
AE11-5VL 1234567890123456789012345678901234567890123456789012345678901
         DIVMTQSPDFHSVTPKEKVTITCRASQSIGSSLHWYQQKPDQSPKLLIRHASQSISGVPSR
           E   L       Q           R  RR              KYV     L
                                   T  TT              P       V
                                   N  GN              T       T
                                   I  NC              G       S
                                   C  KG              S       M
                                   G  CI              E       N
                                   K  HK              D       K
                                   Y  VM                      F
                                   W  PL                      R
                                      LY
                                      P
                                      V
         23456789012345678901234567890123 45a67890123456a
         FSGSGSGTDFTLTIHSLEAEDAATYYCHQSSSSPPPTFGQGTQVEIK
                   N                RRRL LS      K
                                    NGI  AR
                                    GIC  SL
                                    TCG  RT
                                    CNN  TA
                                    ITT  QQ
                                    MK   HH
                                         V
                                         M
```

Example 1.2

Affinity Maturation of a Humanized Human TNF Binding Protein hMAK-195

The mouse anti-human TNF antibody MAK-195 was humanized and affinity-matured to generate a panel of humanized MAK195 variants that have cross-reactivity to cyno-TNF and improved affinity and binding kinetics against both human and cyno TNF.

To improve the affinity of hMAK195 to TNF, hypermutated CDR residues were identified from other human antibody sequences in the IgBLAST database that also shared high identity to germlines VH3-53 and IGKV1-39. The corresponding hMAK195 CDR residues were then subjected to limited mutagenesis by PCR with primers having low degeneracy at these positions to create three antibody libraries in the scFv format. The first library contained mutations at residues 31, 32, 33, 35, 50, 52, 53, 54, 56 and 58 in the VH CDR1 and 2 (Kabat numbering); the second library at residues 95 to 100, 100a, 101, and 102 in VH CDR3; and the third library at residues 28, 30, 31, 32, 50, 53, 92, 93, 94, and 95 in the three VL CDRs. To further increase the identity of hMAK195 to the human germline framework sequences, a binary degeneracy at VH positions 60 (D/A), 61 (S/D), 62 (T/S), 63 (L/V), and 65 (S/G) were introduced into the first library. Also, a binary degeneracy at VL positions 24 (K/R), 33 (V/L), 54 (R/L), 55 (H/Q), 56 (T/S), 91 (H/S) and 96 (F/Y) were introduced into the third library.

These hMAK195 selected against a low concentration of biotinylated TNF for improved on-rate, off-rate, or both were carried out and antibody protein sequences of affinity-modulated hMAK195 were recovered for converting back to IgG for further characterization. All three libraries were selected separately for the ability to bind human or cyno-molgus monkey TNF in the presence of decreasing concentrations of biotinylated human or cynomolgus monkey TNF antigens. All mutated CDR sequences recovered from library selections were recombined into additional libraries and the recombined libraries were subjected to more stringent selection conditions before individual antibodies are identified.

The table below (Table 3) provides a list of amino acid sequences of VH and VL of the humanized MAK-195 which were subjected to the affinity maturation selection protocol Amino acid residues of individual CDRs of each VH and VL sequence are indicated in bold.

TABLE 3

Amino acid residues observed in affinity matured hMAK-195.

hMAK195 Heavy chain variable region (SEQ ID NO: 807)

```
hMAK195VH EVQLVESGGGLVQPGGSLRLSCAASGFTFSDYGVNWVRQAPGKGLEWVSMIWGDGSTD
                                       NFS T              I RAG T A
                                       HLN S              V GSE F H
                                       YS  H              L SDA A V
                                       IR  Q              R AEV Y S
                                           Y              K LVG W N
                                                          S NY    G
          YDSTLKSRFTISRDNSKNTLYLQMNSLRAEDTAVYYCAREWHHGPVAYWGQGTLVTVSS
              ADSV G                              HSQQRTLDS
                                                  QLRPASGVF
                                                  LCLLVQDGC
                                                  YRYNWAETN
                                                  DFPYEKW P
                                                  NDARS R I
                                                  TYVTP P H
                                                  PPDDI A
                                                  AICA  I
                                                  SG C
                                                  R
``` hMAK195 Light chain variable region (SEQ ID NO: 808)

```
hMAK195VL DIQMTQSPSSLSASVGDRVTITCKASQAVSSAVAWYQQKPGKAPKLLIYWASTRHTG
                                 R   S RRPL                 S  SLQS
                                 V   TNT                    R  I T
                                 G   IGG                    L  L A
                                 D   NCV                    C  K E
                                 T   CTS                    Q  A F
                                 P   KIR                    G  R
          VPSRFSGSGSGTDFTLTISSLQPEDFATYYCQQHYSTPFTFGQGTKLEIK
                                         SNRSTY
                                         FGPR
                                         DTML
                                         GIIQ
                                         HCAA
                                         S
```

Tables 1D and E above in section IIA) provide a list of humanized MAK-195 antibodies that were converted into IgG proteins for characterization.

Heavy and light chain pairs were prepared as follows in Table 4:

TABLE 4

Heavy and light chain pairs of hMAK195 affinity matured clones

| Clone name | HC | LC | Protein name |
|---|---|---|---|
| A8 | hMAK195-A8 | hMAK195 VL.1 | hMAK195-AM11 |
| B5 | hMAK195-B5 | hMAK195 VL.1 | hMAK195-AM13 |
| rHC3 | hMAK195 rHC3 | hMAK195 VL.1 | hMAK195-AM14 |
| rHC18 | hMAK195 rHC18 | hMAK195 VL.1 | hMAK195-AM15 |
| rHC19 | hMAK195 rHC19 | hMAK195 VL.1 | hMAK195-AM16 |
| rHC22 | hMAK195 rHC22 | hMAK195 VL.1 | hMAK195-AM17 |
| rHC34 | hMAK195 rHC34 | hMAK195 VL.1 | hMAK195-AM18 |
| rHC60 | hMAK195 rHC60 | hMAK195 VL.1 | hMAK195-AM19 |
| S4-6 | hMAK195 S4-6 | hMAK195 S4-6 | hMAK195-AM20 |
| S4-12 | hMAK195 S4-12 | hMAK195 S4-12 | hMAK195-AM21 |
| S4-17 | hMAK195 S4-17 | hMAK195 S4-17 | hMAK195-AM22 |
| S4-18 | hMAK195 S4-18 | hMAK195 S4-18 | hMAK195-AM23 |
| S4-19 | hMAK195 S4-19 | hMAK195 S4-19 | hMAK195-AM24 |
| S4-24 | hMAK195 S4-24 | hMAK195 S4-24 | hMAK195-AM25 |
| S4-34 | hMAK195 S4-34 | hMAK195 S4-34 | hMAK195-AM26 |

Example 1.3

Affinity Maturation of a Humanized Human TNF Binding Protein hMAK-199

The mouse anti-human TNF antibody MAK-199 was humanized and affinity-matured to generate a panel of humanized MAK195 variants that have improved affinity and binding kinetics against both human and cyno TNF. Several libraries were made according to specifications below:

Three HC libraries were made after the V2I back-mutation was first introduced and confirmed that it did not impact scFv affinity to TNF.

H1+H2 (DDK) Library:
  Limited mutagenesis at 7 residues (T30, N31, N35, T52a, T54, E56, T58)
  Germline toggle: M34I and F63L H1+H2 (QKQ) Library:
  Limited mutagenesis at 7 residues (T30, N31, N35, T52a, T54, E56, T58)
  Germline toggle: M34I and F63L
  Germline back-mutations: D61Q, D62K, K64Q, F67V, F69M, L71T H3 Library:
 Limited mutagenesis at 12 residues 95-100, 100a-100f
 Germline toggle: F91Y
LC Library:
 Limited mutagenesis at 11 residues 28, 30-32, 50, 53, 91-94, 96
 Germline toggles: T51A, Y71F, F87Y, and T43A/V44P (these two co-evolve)
Recombed Libraries:
 VH libraries will be recombined with and without VL library after library diversity is reduced after at least 3 rounds of selection.

All four libraries were selected separately for the ability to bind human or cynomolgus monkey TNF in the presence of decreasing concentrations of biotinylated human or cynomolgus monkey TNF antigens. All mutated CDR sequences recovered from library selections were recombined into additional libraries and the recombined libraries were subjected to more stringent selection conditions before individual antibodies are identified.

The table below (Table 5) provides a list of amino acid sequences of VH and VL of the hMAK-199 antibody which were subjected to the affinity maturation selection protocol Amino acid residues of individual CDRs of each VH and VL sequence are indicated in bold.

TABLE 5

Amino acid residues observed in affinity matured hMAK-199 binding proteins

MAK199 Heavy chain variable region (SEQ ID NO: 809)

```
MAK199 12345678901234567890123456789012345678901234567890012a345678901
VH.2a  EIQLVQSGAEVKKPGASVKVSCKASGYTFTNYGMNWVRQAPGQGLEWMGWINTYTGEPTYAD
           V                            ND II                  N K S  Q
                                        AH  T                  S V H
                                        ST  Q                    Q N
                                        RS  S                    R M
                                        DQ  G                    L K
                                        KK  A                    S A
                                        P   V                    N R
                                        Q                        I Q
                                        M                        D D
                                        G
                                        E
       2345678901234567890012abc345678901234567890abcdefg1234567890123
       DFKGRFTFTLDTSTSTAYMELSSLRSEDTAVYFCARKFLTTVVVTDYAMDYWGQGTTVTVSS
       GLT  V M T                   Y   RLFNPMDASENT
       K Q                              NYMKVEAEM SR
                                        IRSSAEMN  CC
                                        VSRARSD   H
                                        CWL IMG   D
                                        QP  QII   I
                                        VF  GPQ   F
                                        ND  D P   V
                                        GM    N   L
                                        CA    L   A
                                              H
```

Mak199 Light chain variable region (SEQ ID NO: 810)

```
Mak199 12345678901234567890123456789012345678901234567890012345678901
Vk.1a  DIQMTQSPSSLSASVGDRVTITCRASQDISNYLNWYQQKPGKTVKLLIYYTSRLQSGVPSR
                              N YQV              AP      FA L
                              E ESF              V       N  K
                              H AKT                         G
                              G TT
                              V WH
                              R GD
                              A NR
                                F
                                C
       234567890123456789012345678901234567890123456a
       FSGSGSGTDYTLTISSLQPEDFATYFCQQGNTLPPTFGQGTKLEIK
                F               Y   ISW T
                                    MQ  S
                                    IP  A
                                    AM
                                    RR
                                    F
                                    G
                                    V
                                    Y
                                    A
```

Individual hMAK-199 VH and VL sequences from converted clones were prepared and are shown above in Tables 1F and G in section I)A).

TABLE 6 hMAK199 affinity matured scFv clones converted to full length IgG

| ScFv Clone name | HC plasmid | LC plasmid | Full length IgG (protein) name |
|---|---|---|---|
| J662M2S3#10 | pHybE-hCg1, z, non-a V2 J662M2S3#10 | pHybE-hCk V3 J662 M2S3#10 | hMAK199-AM1 |
| J662M2S3#13 | pHybE-hCg1, z, non-a V2 J662M2S3#13 | pHybE-hCk V3 J662 M2S3#13 | hMAK199-AM2 |
| J662M2S3#15 | pHybE-hCg1, z, non-a V2 J662M2S3#15 | pHybE-hCk V3 J662 M2S3#15 | hMAK199-AM3 |
| J662M2S3#16 | pHybE-hCg1, z, non-a V2 J662M2S3#16 | pHybE-hCk V3 J662 M2S3#16 | hMAK199-AM4 |
| J662M2S3#21 | pHybE-hCg1, z, non-a V2 J662M2S3#21 | pHybE-hCk V3 J662 M2S3#21 | hMAK199-AM5 |
| J662M2S3#34 | pHybE-hCg1, z, non-a V2 J662M2S3#34 | pHybE-hCk V3 J662 M2S3#34 | hMAK199-AM6 |
| J662M2S3#36 | pHybE-hCg1, z, non-a V2 J662M2S3#36 | pHybE-hCk V3 J662 M2S3#36 | hMAK199-AM7 |
| J662M2S3#45 | pHybE-hCg1, z, non-a V2 J662M2S3#45 | pHybE-hCk V3 J662 M2S3#45 | hMAK199-AM8 |
| J662M2S3#58 | pHybE-hCg1, z, non-a V2 J662M2S3#58 | pHybE-hCk V3 J662 M2S3#58 | hMAK199-AM9 |
| J662M2S3#72 | pHybE-hCg1, z, non-a V2 J662M2S3#72 | pHybE-hCk V3 J662 M2S3#72 | hMAK199-AM10 |

Example 1.4

Affinity Determination Using BIACORE Technology

TABLE 7

Reagent for Biacore Analyses

| Antigen | Vendor Designation | Vendor | Catalog # |
|---|---|---|---|
| TNFα | Recombinant Human TNF-α/TNFSF1A | R&D systems | 210-TA |

BIACORE Methods:

The BIACORE assay (Biacore, Inc. Piscataway, N.J.) determines the affinity of binding proteins with kinetic measurements of on-rate and off-rate constants. Binding of binding proteins to a target antigen (for example, a purified recombinant target antigen) is determined by surface plasmon resonance-based measurements with a Biacore® 1000 or 3000 instrument (Biacore® AB, Uppsala, Sweden) using running HBS-EP (10 mM HEPES [pH 7.4], 150 mM NaCl, 3 mM EDTA, and 0.005% surfactant P20) at 25° C. All chemicals are obtained from Biacore® AB (Uppsala, Sweden) or otherwise from a different source as described in the text. For example, approximately 5000 RU of goat anti-mouse IgG, (Fcγ), fragment specific polyclonal antibody (Pierce Biotechnology Inc, Rockford, Ill., US) diluted in 10 mM sodium acetate (pH 4.5) is directly immobilized across a CM5 research grade biosensor chip using a standard amine coupling kit according to manufacturer's instructions and procedures at 25 µg/ml. Unreacted moieties on the biosensor surface are blocked with ethanolamine. Modified carboxymethyl dextran surface in flowcell 2 and 4 is used as a reaction surface. Unmodified carboxymethyl dextran without goat anti-mouse IgG in flow cell 1 and 3 is used as the reference surface. For kinetic analysis, rate equations derived from the 1:1 Langmuir binding model are fitted simultaneously to association and dissociation phases of all eight injections (using global fit analysis) with the use of Biaevaluation 4.0.1 software. Purified antibodies are diluted in HEPES-buffered saline for capture across goat anti-mouse IgG specific reaction surfaces. Antibodies to be captured as a ligand (25 µg/ml) are injected over reaction matrices at a flow rate of 5 µl/minute. The association and dissociation rate constants, $k_{on}$ ($M^{-1}$ $s^{-1}$) and $k_{off}$ ($s^{-1}$), are determined under a continuous flow rate of 25 µl/minute. Rate constants are derived by making kinetic binding measurements at different antigen concentrations ranging from 10-200 nM. The equilibrium dissociation constant (M) of the reaction between antibodies and the target antigen is then calculated from the kinetic rate constants by the following formula: $K_D = k_{off}/k_{on}$. Binding is recorded as a function of time and kinetic rate constants are calculated. In this assay, on-rates as fast as $10^6 M^{-1}$ $s^{-1}$ and off-rates as slow as $10^{-6}$ $s^{-1}$ can be measured.

The binding proteins herein are expected to have beneficial properties in this regard, including high affinity, slow off rate, and high neutralizing capacity.

Example 1.5

Neutralization of Human TNF-α

L929 cells are grown to a semi-confluent density and harvested using 0.25% trypsin (Gibco#25300). The cells are washed with PBS, counted and resuspended at 1E6 cells/mL in assay media containing 4 µg/mL actinomycin D. The cells are seeded in a 96-well plate (Costar#3599) at a volume of 100 µL and 5E4 cells/well. The binding proteins and control IgG are diluted to a 4× concentration in assay media and serial 1:4 dilutions are performed. The huTNF-α is diluted to 400 pg/mL in assay media. Binding protein sample (200 µL) is added to the huTNF-α (200 µL) in a 1:2 dilution scheme and allowed to incubate for 0.5 hour at room temperature.

The binding protein/human TNF-α solution is added to the plated cells at 100 µL for a final concentration of 100 pg/mL huTNF-α and 150 nM-0.0001 nM binding protein. The plates are incubated for 20 hours at 37° C., 5% $CO_2$. To quantitate viability, 100 µL is removed from the wells and 10 µL of WST-1 reagent (Roche cat#11644807001) is added. Plates are incubated under assay conditions for 3.5 hours. The plates are read at OD 420-600 nm on a Spectromax 190 ELISA plate reader.

The binding proteins herein are expected to have beneficial properties in this regard, including high affinity, slow off rate, and high neutralizing capacity.

Example 2

Affinity Maturation of the Humanized Anti-Human IL-17 Antibody h10F7

The humanized anti-human IL-17 antibody was previously disclosed. This antibody was subsequently affinity matured to improve its overall affinity to human, cynomolgus monkey, and mouse IL-17. Several libraries were made according to specifications below: H1+H2 library:

Limited mutagenesis at 7 residues at 30, 31, 33, 35, 53, 56, 57, and 58.

Toggle between human germline and h10F7 sequences at positions 27, 48, 51, 52, 54, 67, and 69.

H3 Library:
  Limited mutagenesis at 95-100c and 102.
  Toggle between human germline and h10F7 sequences at 93.
LC Library 1:
  Limited mutagenesis at 30, 31, 32, 34, 50, 53, 89, 91, 92, 93, and 96.
  Toggle between human germline and h10F7 sequence at positions 4, 24, 27, 29, 33, 36, 43, 47, 52, and 55.
LC library 2: constructed with an additional residue at position G28 in CDR1 to increase identity to human antibodies.
  Limited mutagenesis at 28, 30, 31, 32, 34, 50, 53, 89, 91, 92, 93, and 96.
  Toggle between human germline and h10F7 sequence at positions 24, 27, 29, 33, 37, 44, 48, 52, and 55.
  One framework germ-lining mutation in FR1 (position 4) to be tested first as scFv. "M" will be used over "L" if binding is not affected.

rHC library: recombine outputs of H1+H2 and H3 libraries.

rHCLC library: recombine outputs of H1+H2, H3, and LC1 or LC2 libraries. (LC2 used over LC1 if LC2 output binding appears to be at least as good as WT, otherwise recombine LC1 output).

All four libraries were selected separately for the ability to bind human, cynomolgus monkey and mouse IL-17 in the presence of decreasing concentrations of biotinylated antigens. All mutated CDR sequences recovered from library selections were recombined into additional libraries and the recombined libraries were subjected to more stringent selection conditions before individual antibodies are identified.

Table 8 provides a list of VH amino acid sequences of h10F7 antibody that were subjected to the affinity maturation selection protocol Amino acid residues of individual CDRs of each VH sequence are indicated in bold.

TABLE 8

List of amino acid sequences of affinity matured h10F7 VH variants

| Clone | SEQ ID NO: | VH |
|---|---|---|
| J417M2S2-12VH | 121 | EVQLVQSGAEVKKPGSSVKVSCKASGYTFTDYEIH WVRQAPGQGLEWIGVNDPDSGGTFYNQKFDGRVTI TADKSTSTAYMELSSLRSEDTAVYYCTRYYRYESF YGMDYWGQGTTVTVSS |
| J417M2S2-15VH | 122 | EVQLVQSGAEVKKPGSSVKVSCKASGYTFDDYEIH WVRQAPGQGLEWMGVIDPESGGTLYNQKFDGRVTL TADKSTSTAYMELSSLRSEDTAVYYCTRYYRYESF YGMDYWGQGTTVTVSS |
| J417M2S2-16VH | 123 | EVQLVQSGAEVKKPGSSVKVSCKASGYTFTDYEIH WVRQAPGQGLEWIGVNDPDSGGTLYNQKFDGRVTL TADKSTSTAYMELSSLRSEDTAVYYCTRYYRYESF YGMDYWGQGTTVTVSS |
| J417M2S2-18VH | 124 | EVQLVQSGAEVKKPGSSVKVSCKASGYTFTDYEIH WVRQAPGQGLEWMGVNDPDSGGTLYNQKFDGRVTI TADESTSTAYMELSSLRSEDTAVYYCTRYYRYESF YGMDYWGQGTTVTVSS |
| J417M2S2-20VH | 125 | EVQLVQSGAEVKKPGSSVKVSCKASGYTFDDYEIH WVRQAPGQGLEWIGVNDPESGGTMYNQKFDGRVTI TADKSTSTAYMELSSLRSEDTAVYYCTRYYRYESF YGMDYWGQGTTVTVSS |
| J417M2S2-23VH | 126 | EVQLVQSGAEVKKPGSSVKVSCKASGYTFDDYEIH WVRQAPGQGLEWIGVNDPESGGTFYNQKFDGRATL TADKSTSTAYMELSSLRSEDTAVYYCTRYYRYESF YGMDYWGQGTTVTVSS |
| J417M2S2-25VH | 127 | EVQLVQSGAEVKKPGSSVKVSCKASGYTFTDYEIH WVRQAPGQGLEWIGVNDPESGGTLYNQKFDGRVTL TADKSTSTAYMELSSLRSEDTAVYYCTRYYRYESF YGMDYWGQGTTVTVSS |
| J417M2S2-26VH | 128 | EVQLVQSGAEVKKPGSSVKVSCKASGYTFTDYEIH WVRQAPGQGLEWIGVNDPESGGTFYNQKFDGRATL TADESTSTAYMELSSLRSEDTAVYYCTRYYRYESF YGMDYWGQGTTVTVSS |
| J417M2S2-34VH | 129 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYYRYESF YGMDYWGQGTTVTVSS |
| J417M2S2-37VH | 130 | EVQLVQSGAEVRKPGSSVKVSCKASGYTFEDYEIH WVRQAPGQGLEWMGVIDPESGGTLYNQKFDGRVTL TADKSTSTAYMELSSLRSEDTAVYYCTRYYRYESF YGMDYWGQGTTVTVSS |

TABLE 8-continued

List of amino acid sequences of affinity matured h10F7 VH variants

| Clone | SEQ ID NO: | VH |
|---|---|---|
| J417M2S2-47VH | 131 | EVQLVQSGAEVKKPGSSVKVSCKASGYTFDDYEIHWVRQAPGQGLEWIGVNDPESGGTLYNQKFDGRVTLTADESTSTAYMELSSLRSEDTAVYYCTRYYRYESFYGMDYWGQGTTVTVSS |
| J417M2S2-4VH | 132 | EVQLVQSGAEVKKPGSSVKVSCKASGYTFDDYEIHWVRQAPGQGLEWMGVIDPESGGTLYNQKFDGRVTLTADKSTSTAYMELSSLRSEDTAVYYCTRYYRYESFYGMDYWGQGTTVTVSS |
| J417M2S2-50VH | 133 | EVQLVQSGAEVKKPGSSVKVSCKASGYTFDDYEIHWVRQAPGQGLEWMGVIDPESGGTLYNQKFDGRATLTADKSTSTAYMELSSLRSEDTAVYYCTRYYRYESFYGMDYWGQGTTVTVSS |
| J417M2S2-51VH | 134 | EVQLVQSGAEVKKPGSSVKVSCKASGYTFEDYEIHWVRQAPGQGLEWMGVIDPESGGTLYNQKFDGRVTLTADKSTSTAYMELSSLRSEDTAVYYCTRYYRYESFYGMDYWGQGTTVTVSS |
| J417M2S2-55VH | 135 | EVQLVQSGAEVKKPGSSVKVSCKASGYTFDDYEIHWVRQAPGQGLEWMGVNDPESGGTLYNQKFDGRVTITADKSTSTAYMELSSLRSEDTAVYYCTRYYRYESFYGMDYWGQGTTVTVSS |
| J417M2S2-56VH | 136 | EVQLVQSGAEVKKPGSSVKVSCKASGYTFTDYEIHWVRQAPGQGLEWMGVNDPESGGTLYNQKFDGRVTLTADKSTSTAYMELSSLRSEDTAVYYCTRYYRYESFHGMDYWGQGTTVTVSS |
| J417M2S2-57VH | 137 | EVQLVQSGAEVKKPGSSVKVSCKASGYTFADYEIHWVRQAPGQGLEWIGVNDPESGGTFYNQKFDGRATLTADKSTSTAYMELSSLRSEDTAVYYCTRYYRYESFYGMDYWGQGTTVTVSS |
| J417M2S2-64VH | 138 | EVQLVQSGAEVKKPGSSVKVSCKASGYTFDDYEIHWVRQAPGQGLEWMGVNDPDSGGTLYNQKFDGRVTITADKSTSTAYMELSSLRSEDTAVYYCTRYYRYESFYGMDYWGQGTTVTVSS |
| J417M2S2-65VH | 139 | EVQLVQSGAEVKKPGSSVKVSCKASGYTFSDYEIHWVRQAPGQGLEWIGVNDPESGGTLYNQKFDGRVTITADKSTSTAYMELSSLRSEDTAVYYCTRYYRYESFYGMDYWGQGTTVTVSS |
| J417M2S2-69VH | 140 | EVQLVQSGAEVKKPGSSVKVSCKASGYTFEDYEIHWVRQAPGQGLEWMGVIDPESGGTLYNQKFDGRATITADKSTSTAYMELSSLRSEDTAVYYCTRYYRYESFYGMDYWGQGTTVTVSS |
| J417M2S2-72VH | 141 | EVQLVQSGAEVKKPGSSVKVSCKASGYTFTDYEIHWVRQAPGQGLEWIGVNDPESGGTLYNQKFDGRVTITADKSTSTAYMELSSLRSEDTAVYYCTKYYRYESFYGMDYWGQGTTVTVSS |
| J417M2S2-73VH | 142 | EVQLVQSGAEVKKPGSSVKVSCKASGYTFTDYEIHWVRQAPGQGLEWIGVIDPESGGTLYNQKFDGRATITADESTSTAYMELSSLRSEDTAVYYCTRYYRYESFYGMDYWGQGTTVTVSS |
| J417M2S2-75VH | 143 | EVQLVQSGAEVKKPGSSVKVSCKASGYTFDDYEIHWVRQAPGQGLEWIGVNDPESGGTLYNQKFDGRATITADKSTSTAYMELSSLRSEDTAVYYCTRYYRYESFYGMDYWGQGTTVTVSS |
| J417M2S2-76VH | 144 | EVQLVQSGAEVKKPGSSVKVSCKASGYTFTEYEIHWVRQAPGQGLEWMGVNDPESGGSFYNQKFDGRVTLTADKSTSTAYMELSSLRSEDTAVYYCTRYYRYESFYGMDYWGQGTTVTVSS |
| J417M2S2-7VH | 145 | EVQLVQSGAEVKKPGSSVKVSCKASGYTFTDYEIHWVRQAPGQGLEWIGVNDPESGGTFYNQKFDGRVTLTADKSTSTAYMELSSLRSEDTAVYYCTRYYRYESFYGMDYWGQGTTVTVSS |

TABLE 8-continued

List of amino acid sequences of affinity matured h10F7 VH variants

| Clone | SEQ ID NO: | VH |
|---|---|---|
| J417M2S2-84VH | 146 | EVQLVQSGAEVKKPGSSVKVSCKASGYTFDDYEIH<br>WVRQAPGQGLEWIGVIDPESGGSLYNQKFDGRVTI<br>TADKSTSTAYMELSSLRSEDTAVYYCTRYYRYESF<br>YGMDYWGQGTTVTVSS |
| J417M2S2-85VH | 147 | EVQLVQSGAEVKKPGSSVKVSCKASGYTFDDYEIH<br>WVRQAPGQGLEWMGVIDPESGGTLYNQKFDGRATI<br>TADKSTSTAYMELSSLRSEDTAVYYCTRYYRYESF<br>YGMDYWGQGTTVTVSS |
| J417M2S2-86VH | 148 | EVQLVQSGAEVKKPGSSVKVSCKASGYTFDDYEIH<br>WVRQAPGQGLEWIGVNDPESGGTLYNQKFDGRATL<br>TADKSTSTAYMELSSLRSEDTAVYYCTRYYRYESF<br>YGMDYWGQGTTVTVSS |
| J417M2S2-89VH | 149 | EVQLVQSGAEVKKPGSSVKVSCKASGYTFDDYEIH<br>WVRQAPGQGLEWMGVIDPESGGSLYNQKFDGRVTL<br>TADKSTSTAYMELSSLRSEDTAVYYCTRYYRYESF<br>YGMDYWGQGTTVTVSS |
| J417M2S2-91VH | 150 | EVQLVQSGAEVKKPGSSVKVSCKASGYTFDDYEIH<br>WVRQAPGQGLEWIGVNDPDSGGTLYNQKFDGRVTI<br>TADKSTSTAYMELSSLRSEDTAVYYCTRYYRYESF<br>YGMDYWGQGTTVTVSS |
| J417M2S2-95VH | 151 | EVQLVQSGAEVKKPGSSVKVSCKASGYTFTDYEIH<br>WVRQAPGQGLEWIGVNDPESGGILYNQKFDGRATL<br>TADKSTSTAYMELSSLRSEDTAVYYCTRYYRYESF<br>YGMDYWGQGTTVTVSS |
| J417M2S2-96VH | 152 | EVQLVQSGAEVKKPGSSVKVSCKASGYTFSDYEIH<br>WVRQAPGQGLEWMGVNDPESGGTFYNQKFDGRVTL<br>TADESTSTAYMELSSLRSEDTAVYYCTRYYRYESF<br>YGMDYWGQGTTVTVSS |
| J417M2S3-14VH | 153 | EVQLVQSGAEVKKPGSSVKVSCKASGYTFDDYEIH<br>WVRQAPGQGLEWIGVNDPESGGTLYNQKFDGRVTI<br>TADKSTSTAYMELSSLRSEDTAVYYCTRYYRYESF<br>YGMDYWGQGTTVTVSS |
| J417M2S3-35VH | 154 | EVQLVQSGAEVKKPGSSVKVSCKASGYTFDEYEIH<br>WVRQAPGQGLEWMGVIDPESGGTLYNQKFDGRVTL<br>TADKSTSTAYMELSSLRSEDTAVYYCTRYYRYESF<br>YGMDYWGQGTTVTVSS |
| J417M2S3-54VH | 155 | EVQLVQSGAEVKKPGSSVKVSCKASGYTFTDYEIH<br>WVRQAPGQGLEWMGVNDPESGGTLYNQKFDGRVTL<br>TADKSTSTAYMELSSLRSEDTAVYYCTRYYRYESF<br>YGMDYWGQGTTVTVSS |
| J417M2S3-63VH | 156 | EVQLVQSGAEVKKPGSSVKVSCKASGYTFTDYEIH<br>WVRQAPGQGLEWIGVIDPESGGTLYNQKFDGRVTL<br>TADKSTSTAYMELSSLRSEDTAVYYCTRYYRYESF<br>YGMDYWGQGTTVTVSS |
| J417M2S3-81VH | 157 | EVQLVQSGAEVKKPGSSVKVSCKASGYTFTDYEIH<br>WVRQAPGQGLEWIGVNDPESGGTLYNQKFDGRATI<br>TADKSTSTAYMELSSLRSEDTAVYYCTRYYRYESF<br>YGMDYWGQGTTVTVSS |
| J417M2S3-83VH | 158 | EVQLVQSGAEVKKPGSSVKVSCKASGYTFTDYEIH<br>WVRQAPGQGLEWMGVIDPESGGSFYNQKFDGRATL<br>TADKSTSTAYMELSSLRSEDTAVYYCTRYYRYESF<br>YGMDYWGQGTTVTVSS |
| J417M2S3-86VH | 159 | EVQLVQSGAEVKKPGSSVKVSCKASGYTFTDYEIH<br>WVRQAPGQGLEWMGVNDPESGGTLYNQKFDGRATI<br>TADKSTSTAYMELSSLRSEDTAVYYCTRYYRYESF<br>YGMDYWGQGTTVTVSS |
| J417M2S3-89VH | 160 | EVQLVQSGAEVKKPGSSVKVSCKASGYTFDDYEIH<br>WVRQAPGQGLEWIGVNDPESGGTLYNQKFDGRVTL<br>TTDKSTSTAYMELSSLRSEDTAVYYCTRYYRYESF<br>YGMDYWGQGTTVTVSS |

TABLE 8-continued

List of amino acid sequences of affinity matured h10F7 VH variants

| Clone | SEQ ID NO: | VH |
|---|---|---|
| J420M2S2-1VH | 161 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDKWYSF YGMDYWGQGTTVTVSS |
| J420M2S2-20VH | 162 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYSKYWSF SGMDYWGQGTTVTVSS |
| J420M2S2-21VH | 163 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDKYFGF SGMDFWGQGTTVTVSS |
| J420M2S2-22VH | 164 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDKFDSF QGMDYWGQGTTVTVSS |
| J420M2S2-28VH | 165 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDKYEGF LGMDYWGQGTTVTVSS |
| J420M2S2-30VH | 166 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDKYWSF YGMDYWGQGTTVTVSS |
| J420M2S2-34VH | 167 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDKFESF NGMDYWGQGTTVTVSS |
| J420M2S2-39VH | 168 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDKYESF SGMDYWGQGTTVTVSS |
| J420M2S2-40VH | 169 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDKWEGF YGMDYWGQGTTVTVSS |
| J420M2S2-41VH | 170 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDKWESF YGMDFWGQGTTVTVSS |
| J420M2S2-47VH | 171 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDKWDGF NGMDYWGQGTTVTVSS |
| J420M2S2-50VH | 172 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDKWDSF YGMDYWGQGTTVTVSS |
| J420M2S2-51VH | 173 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDKYESF YGMDYWGQGTTVTVSS |
| J420M2S2-53VH | 174 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYDRYWSF NGMDYWGQGTTVTVSS |
| J420M2S2-56VH | 175 | EVQLVQSGAEVKKPGSSVKVSCKASGYTFTDYEIH WVRQAPGQGLEWIGVNDPESGGTFYNQKFDGRATL TADKSTSTAYMELSSLRSEDTAVYYCTRYYKWDSF LGMDFWGQGTTVTVSS |

TABLE 8-continued

List of amino acid sequences of affinity matured h10F7 VH variants

| Clone | SEQ ID NO: | VH |
|---|---|---|
| J420M2S2-57VH | 176 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDMWESFNGMDYWGQGTTVTVSS |
| J420M2S2-58VH | 177 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYKWWGFMGMDYWGQGTTVTVSS |
| J420M2S2-60VH | 178 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYRYWGFEGMDYWGQGTTVTVSS |
| J420M2S2-64VH | 179 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYWSFQGMDYWGQGTTVTVSS |
| J420M2S2-65VH | 180 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYESFEGMDYWGQGTTVTVSS |
| J420M2S2-67VH | 181 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWMSFSGMDYWGQGTTVTVSS |
| J420M2S2-71VH | 182 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKFYGFNGMDYWGQGTTVTVSS |
| J420M2S2-72VH | 183 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYKWDSFYGMDAWGQGTTVTVSS |
| J420M2S2-79VH | 184 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYSKWDSFSGMDYWGQGTTVTVSS |
| J420M2S2-80VH | 185 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWESFYGMDYWGQGTTVTVSS |
| J420M2S2-87VH | 186 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWWSFSGMDYWGQGTTVTVSS |
| J420M2S2-89VH | 187 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWESFAGMDYWGQGTTVTVSS |
| J420M2S2-95VH | 188 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYRWESFQGMDYWGQGTTVTVSS |
| J420M2S2-9VH | 189 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYESLNGMDYWGQGTTVTVSS |
| J420M2S3-12VH | 190 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYWKWDSFFGMDYWGQGTTVTVSS |

TABLE 8-continued

List of amino acid sequences of affinity matured h10F7 VH variants

| Clone | SEQ ID NO: | VH |
|---|---|---|
| J420M2S3-21VH | 191 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWESFSGMDYWGQGTTVTVSS |
| J420M2S3-25VH | 192 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYVGFEGMDYWGQGTTVTVSS |
| J420M2S3-27VH | 193 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKFWSFNGMDYWGQGTTVTVSS |
| J420M2S3-29VH | 194 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYSKWDSFQGMDYWGQGTTVTVSS |
| J420M2S3-32VH | 195 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYFKWDSFEGMDYWGQGTTVTVSS |
| J420M2S3-39VH | 196 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYSKWNSFDGMDYWGQGTTVTVSS |
| J420M2S3-3VH | 197 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYSKWDSFDGMDYWGQGTTVTVSS |
| J420M2S3-55VH | 198 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWESFNGMDYWGQGTTVTVSS |
| J420M2S3-57VH | 199 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYWKWDSFYGMDSWGQGTTVTVSS |
| J420M2S3-68VH | 200 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKFDSFYGMDYWGQGTTVTVSS |
| J420M2S3-70VH | 201 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWEGFRGMDLWGQGTTVTVSS |
| J420M2S3-73VH | 202 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYEKWDSFNGMDYWGQGTTVTVSS |
| J420M2S3-76VH | 203 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYKWESFQGMDYWGQGTTVTVSS |
| J420M2S3-77VH | 204 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKFYSFNGMDYWGQGTTVTVSS |
| J420M2S3-94VH | 205 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYNKWDSFLGMDYWGQGTTVTVSS |

TABLE 8-continued

List of amino acid sequences of affinity matured h10F7 VH variants

| Clone | SEQ ID NO: | VH |
|---|---|---|
| J425M2S2-29VH | 206 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYESFNGMDYWGQGTTVTVSS |
| J425M2S2-41VH | 207 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYRYESFYGMDYWGKGTTVTVSS |
| J427M2S3-88VH | 208 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYRYESFYGMDYWGQGTTVTVSS |
| J427M2S3-91VH | 209 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYRYESFYGMDYWGQGTTVTVSS |
| J439M1S2(H)3-A12VH | 210 | EVQLVQSGAEVKKPGSSVKVSCKASGYTFTDYEIHWVRQAPGQGLEWMGVNDPESGGTLYNQKFDGRVTLTADESTSTAYMELSSLRSEDTAVYYCTRYDRYWSFNGMDYWGQGTTVTVSS |
| J439M1S2(H)3-A3VH | 211 | EVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYWKWDSFFGMDYWGQGTTVTVSS |
| J439M1S2(H)3-B18VH | 212 | EVQLVQSGAEVKKPGSSVKVSCKASGYTFTDYEIHWVRQAPGQGLEWIGVNDPESGGTFYNQKFDGRVTLTADKSTSTAYMELSSLRSEDTAVYYCTRYDKWYSFEGMDIWGQGTTVTVSS |
| J439M1S2(H)3-B19VH | 213 | EVQLVQSGAEVKKPGSSVKVSCKASGYTFPDYEIHWVRQAPGQGLEWIGVNDPESGGTFYNQKFDGRATLTADESTSTAYMELSSLRSEDTAVYYCTRYDKWESFNGMDYWGQGTTVTVSS |
| J439M1S2(H)3-B23VH | 214 | EVQLVQSGAEVKKPGSSVKVSCKASGYTFTDYEIHWVRQAPGQGLEWIGVNDPESGGTYYNQKFDGRATLTADESTSTAYMELSSLRSEDTAVYYCTRYSKWDSFQGMDYWGQGTTVTVSS |
| J439M1S2(H)3-B2VH | 215 | EVQLVQSGAEVKKPGSSVKVSCKASGYTFDDYEIHWVRQAPGQGLEWIGVNDPESGGTFYNQKFDGRATLTADESTSTAYMELSSLRSEDTAVYYCTRYSKWDSFLGMDYWGQGTTVTVSS |
| J439M1S2(H)3-B38VH | 216 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKYWSFQGMDYWGQGTTVTVSS |
| J439M1S2(H)3-B40VH | 217 | EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKYWSFEGMDYWGQGTTVTVSS |
| J439M1S2(H)3-B51VH | 218 | EVQLVQSGAEVKKPGSSVKVSCKASGYTFSDYEIHWVRQAPGQGLEWIGVNDPESGGTFYNQKFDGRATLTADKSTSTAYMELSSLRSEDTAVYYCTRYDKWYSFEGMDIWGQGTTVTVSS |
| J439M1S2(H)3-B52VH | 219 | EVQLVQSGAEVKKPGSSVKVSCKASGYTFDDYEIHWVRQAPGQGLEWMGVNDPESGGTFYNQKFDGRVTLTADKSTSTAYMELSSLRSEDTAVYYCTRYDKWESFNGMDEWGQGTTVTVSS |
| J439M1S2(H)3-B5VH | 220 | EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKWDSFYGMDYWGQGTTVTVSS |

TABLE 8-continued

List of amino acid sequences of affinity matured h10F7 VH variants

| Clone | SEQ ID NO: | VH |
|---|---|---|
| J439M1S2(H)3-B62VH | 221 | EVQLVQSGAEVKKPGSSVKVSCKASGYTFNDYEIHWVRQAPGQGLEWIGVNDPESGGTYYNQKFDGRATLTADESTSTAYMELSSLRSEDTAVYYCTRYDKWYSFEGMDIWGQGTTVTVSS |
| J439M1S2(H)3-C13VH | 222 | EVQLVQSGAEVKKPGSSVKVSCKASGYTFTDYEIHWVRQAPGQGLEWIGVNDPESGGTFYNQKFDGRVTLSADESTSTAYMELSSLRSEDTAVYYCTRYDKYWSFEGMDYWGQGTTVTVSS |
| J439M1S2(H)3-C15VH | 223 | EVQLVQSGAEVKKPGSSVKVSCKASGYTFDDYEIHWVRQAPGQGLEWMGVNDPESGGTFYNQKFDGRVTLTADKSTSTAYMELSSLRSEDTAVYYCTRYDKWESFNGMDYWGQGTTVTVSS |
| J439M1S2(H)3-C17VH | 224 | EVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYDKWYSFEGMDIWGQGTTVTVSS |
| J439M1S2(H)3-C19VH | 225 | EVQLVQSGAEVKKPGSSVKVSCKASGYTFDDYEIHWVRQAPGQGLEWIGVNDPESGGTFYNQKFDGRATLTADESTSTAYMELSSLRSEDTAVYYCTRYDKYWSFEGMDYWGQGTTVTVSS |
| J439M1S2(H)3-C20VH | 226 | EVQLVQSGAEVKKPGSSVKVSCKASGYTFADYEIHWVRQAPGQGLEWIGVNDPESGGTFYNQKFDGRVTLTADESTSTAYMELSSLRSEDTAVYYCTRYDKYWSFEGMDYWGQGTTVTVSS |
| J439M1S2(H)3-C21VH | 227 | EVQLVQSGAEVKKPGSSVKVSCKASGYTFDDYEIHWVRQAPGQGLEWMGVNDPESGGTFYNQKFDGRVTLTADESTSTAYMELSSLRSEDTAVYYCTRYEKWDSFNGMDYWGQGTTVTVSS |
| J439M1S2(H)3-C25VH | 228 | EVQLVQSGAEVKKPGSSVKVSCKASGYTFTDYEIHWVRQAPGQGLEWMGVNDPESGGTFYNQKFDGRITLTADESTSTAYMELSSLRSEDTAVYYCTRYDKWYSFEGMDIWGQGTTVTVSS |
| J439M1S2(H)3-C4VH | 229 | EVQLVQSGAEVKKPGSSVKVSCKASGYTFDDYEIHWVRQAPGQGLEWMGVNDPESGGTFYNQKFDGRVTLTADESTSTAYMELSSLRSEDTAVYYCTRYDKYWSLNGMDEWGQGTTVTVSS |
| J439M1S2(H)3-C5VH | 230 | EVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYDRYWSFNGMDYWGQGTTVTVSS |
| J439M1S2(H)3-C6VH | 231 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKYWSFEGMDYWGQGTTVTVSS |
| J439M1S2(H)3-C9VH | 232 | EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKYWSFNGMDYWGQGTTVTVSS |
| J439M1S2(H)3-D11VH | 233 | EVQLVQSGAEVKKPGSSVKVSCKASGYTFPDYEIHWVRQAPGQGLEWIGVNDPESGGTFYNQKFDGRVTLTADESTSTAYMELSSLRSEDTAVYYCTRYDKWYSFEGMDIWGQGTTVTVSS |
| J439M1S2(H)3-D12VH | 234 | EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKWYSFEGMDIWGQGTTVTVSS |
| J439M1S2(H)3-D15VH | 235 | EVQLVQSGAEVKKPGSSVKVSCKASGYTFEDYEIHWVRQAPGQGLEWIGVNDPDSGGTLYNQKFDGRVTLTADKSTSTAYMELSSLRSEDTAVYYCTRYSKWDSFLGMDYWGQGTTVTVSS |

TABLE 8-continued

List of amino acid sequences of affinity matured h10F7 VH variants

| Clone | SEQ ID NO: | VH |
|---|---|---|
| J439M1S2(H)3-D18VH | 236 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKWESFNGMDYWGQGTTVTVSS |
| J439M1S2(H)3-D24VH | 237 | EVQLVQSGAEVKKPGSSVKVSCKASGYTFTDYEIHWVRQAPGQGLEWIGVNDPESGGTFYNQKFDGRATLTADESTSTAYMELSSLRSEDTAVYYCTRYDKWYSFEGMDIWGQGTTVTVSS |
| J439M1S2(H)3-D25VH | 238 | EVQLVQSGAEVKKPGSSVKVSCKASGYTFADYEIHWVRQAPGQGLEWIGVNDPESGGTFYNQKFDGRATLTADESTSTAYMELSSLRSEDTAVYYCTRYDKWYSFEGMDIWGQGTTVTVSS |
| J439M1S2(H)3-D29VH | 239 | EVQLVQSGAEVKKPGSSVKVSCKASGYTFDDYEIHWVRQAPGQGLEWIGVNDPESGGTLYNQKFDGRVTLTTDKSTSTAYMELSSLRSEDTAVYYCTRYDKWYSFEGMDIWGQGTTVTVSS |
| J439M1S2(H)3-D2VH | 240 | EVQLVQSGAEVKKPGSSVKVSCKASGYTFTDYEIHWVRQAPGQGLEWIGVNDPESGGTFYNQKFDGRATLTADESTSTAYMELSSLRSEDTAVYYCTRYDKWESFNGMDYWGQGTTVTVSS |
| J439M1S2(H)3-D30VH | 241 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWYSFEGMDIWGQGTTVTVSS |
| J439M1S2(H)3-D36VH | 242 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKWYSFEGMDIWGQGTTVTVSS |
| J439M1S2(H)3-D38VH | 243 | EVQLVQSGAEVKKPGSSVKVSCKASGYTFDDYEIHWVRQAPGQGLEWMGVNDPESGGTFYNQKFDGRVTLTADESTSTAYMELSSLRSEDTAVYYCTRYDKWDSFYGMDYWGQGTTVTVSS |
| J439M1S2(H)3-D3VH | 244 | EVQLVQSGAEVKKPGSSVKVSCKASGYTFDDYEIHWVRQAPGQGLEWMGVNDPESGGTFYNQKFDGRVTLTADESTSTAYMELSSLRSEDTAVYYCTRYDKWYSFEGMDIWGQGTTVTVSS |
| J439M1S2(H)3-D6VH | 245 | EVQLVQSGAEVRKPGSSVKVSCKASGYTFEDYEIHWVRQAPGQGLEWMGVIDPESGGTLYNQKFDGRVTLTADESTSTAYMELSSLRSEDTAVYYCTRYDKWYSFEGMDIWGQGTTVTVSS |
| J439M1S2(H)3-D8VH | 246 | EVQLVQSGAEVKKPGSSVKVSCKASGYTFDDYEIHWVRQAPGQGLEWMGVNDPESGGTFYNQKFDGRVTLTADESTSTAYMELSSLRSEDTAVYYCTRYDKWWSFSGMDYWGQGTTVTVSS |
| J439M1S2(H)3-D9VH | 247 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| J439M1S2(H)R4-A10VH | 248 | EVQLVQSGAEVKKPGSSVKVSCKASGYTFADYEIHWVRQAPGQGLEWIGVNDPESGGTFYNQKFDGRATLTADKSTSTAYMELSSLRSEDTAVYYCTRYDKWESFNGMDYWGQGTTVTVSS |
| J439M1S2(H)R4-A11VH | 249 | EVQLVQSGAEVKKPGSSVKVSCKASGYTFADYEIHWVRQAPGQGLEWIGVNDPESGGTFYNQKFDGRATLTADKSTSTAYMELSSLRSEDTAVYYCTRYSKWDSFDGMDYWGQGTTVTVSS |
| J439M1S2(H)R4-A12VH | 250 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWYSFEGMDIWGQGTTVTVSS |

TABLE 8-continued

List of amino acid sequences of affinity matured h10F7 VH variants

| Clone | SEQ ID NO: | VH |
|---|---|---|
| J439M1S2(H)R4-A1VH | 251 | EVQLVQSGAEVKKPGSSVKVSCKASGYTFTDYEIHWVRQAPGQGLEWIGVNDPESGGTFYNQKFDGRATLTADESTSTAYMELSSLRSEDTAVYYCTRYDKWDSFYGMDCWGQGTTVTVSS |
| J439M1S2(H)R4-A4VH | 252 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYWKWDSFYGMDSWGQGTTVTVSS |
| J439M1S2(H)R4-A5VH | 253 | EVQLVQSGAEVKKPGSSVKVSCKASGYTFDDYEIHWVRQAPGQGLEWMGVNDPESGGTFYNQKFDGRVTLTADKSTSTAYMELSSLRSEDTAVYYCTRYDKWYSFEGMDIWGQGTTVTVSS |
| J439M1S2(H)R4-A6VH | 254 | EVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYDKWESFNGMDYWGQGTTVTVSS |
| J439M1S2(H)R4-A9VH | 255 | EVQLVQSGAEVKKPGSSVKVSCKASGYTFTDYEIHWVRQAPGQGLEWIGVNDPESGGTFYNQKFDGRATLTADESTSTAYMELSSLRSEDTAVYYCTRYDKWDGFNGMDYWGQGTTVTVSS |
| J439M1S2(H)R4-B10VH | 256 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYSKWDSFLGMDYWGQGTTVTVSS |
| J439M1S2(H)R4-B2VH | 257 | EVQLVQSGAEVKKPGSSVKVSCKASGYTFSDYEIHWVRQAPGQGLEWIGVNDPDSGGTLYNQKFDGRVTLTADESTSTAYMELSSLRSEDTAVYYCTRYDKWEGFRGMDLWGQGTTVTVSS |
| J439M1S2(H)R4-B5VH | 258 | EVQLVQSGAEVKKPGSSVKVSCKASGYTFTDYEIHWVRQAPGQRLEWIGVNDPESGGTFYNQKFDGRVTLTADESTSTAYMELSSLRSEDTAVYYCTRYDKWESFNGMDYWGQGTTVTVSS |
| J439M1S2(H)R4-B7VH | 259 | EVQLVQSGAEVKKPGSSVKVSCKASGYTFDDYEIHWVRQAPGQGLEWIGVIDPESGGTLYNQKFDGRVTITADESTSTAYMELSSLRSEDTAVYYCTRYDRYWSFEGMDYWGQGTTVTVSS |
| J439M1S2(H)R4-B9VH | 260 | EVQLVQSGAEVKKPGSSVKVSCKASGYTFDDYEIHWVRQAPGQGLEWIGVNDPESGGTLYNQKFDGRVTLTADKSTSTAYMELSSLRSEDTAVYYCTRYDKWYSFEGMDIWGQGTTVTVSS |
| J439M1S2(H)R4-C11VH | 261 | EVQLVQSGAEVKKPGSSVKVSCKASGYTFDDYEIHWVRQAPGQGLEWIGVNDPESGGTLYNQKFDGRVTLTADKSTSTAYMELSSLRSEDTAVYYCTRYDKWYSFEGMDIWGQGTTVTVSS |
| J439M1S2(H)R4-C12VH | 262 | EVQLVQSGAEVKKPGSSVKVSCKASGYTFDEYEIHWVRQAPGQGLEWMGVNDPESGGTLYNQKFDGRVTLTADKSTSTAYMELSSLRSEDTAVYYCTRYDKWDSFYGMDYWGQGTTVTVSS |
| J439M1S2(H)R4-C2VH | 263 | EVQLVQSGAEVKKPGSSVKVSCKASGYTFTDYEIHWVRQAPGQGLEWIGVNDPESGGTLYNQKFDGRATITADESTSTAYMELSSLRSEDTAVYYCTRYYKWDSFEGMDYWGQGTTVTVSS |
| J439M1S2(H)R4-C4VH | 264 | EVQLVQSGAEVKKPGSSVKVSCKASGYTFDDYEIHWVRQAPGQGLEWMGVIDPESGGTLYNQKFDGRVTLTADKSTSTAYMELSSLRSEDTAVYYCTRYDKWYSFEGMDIWGQGTTVTVSS |
| J439M1S2(H)R4-C5VH | 265 | EVQLVQSGAEVKKPGSSVKVSCKASGYTFDDYEIHWVRQAPGQGLEWIGVNDPESGGTFYNQKFDGRVTLTADKSTSTAYMELSSLRSEDTAVYYCTRYDKYWSFEGMDYWGQGTTVTVSS |

TABLE 8-continued

List of amino acid sequences of affinity matured h10F7 VH variants

| Clone | SEQ ID NO: | VH |
|---|---|---|
| J439M1S2(H)R4-C7VH | 266 | EVQLVQSGAEVKKPGSSVKVSCKASGYTFDDYEIHWVRQAPGQGLEWIGVNDPESGGTMYNQKFDGRVTITADKSTSTAYMELSSLRSEDTAVYYCTRYDKWDSFYGMDCWGQGTTVTVSS |
| J439M1S2(H)R4-C8VH | 267 | EVQLVQSGAEVKKPGSSVKVSCKASGYTFDDYEIHWVRQAPGQGLEWIGVNDPDSGGTLYNQKFDGRVTITADKSTSTAYMELSSLRSEDTAVYYCTRYDKWESFNGMDYWGQGTTVTVSS |
| J439M1S2(H)R4-D10VH | 268 | EVQLVQSGAEVKKPGSSVKVSCKASGYTFDDYEIHWVRQAPGQGLEWMGVIDPDSGGTLYNQKFDGRVTLTADKSTSTAYMELSSLRSEDTAVYYCTRYDKWDSFYGMDYWGQGTTVTVSS |
| J439M1S2(H)R4-D11VH | 269 | EVQLVQSGAEVKKPGSSVKVSCKASGYTFDDYEIHWVRQAPGQGLEWMGVIDPESGGILYNQKFDGRVTLTADKSTSTAYMELSSLRSEDTAVYYCTRYDKWESFAGMDYWGQGTTVTVSS |
| J439M1S2(H)R4-D2VH | 270 | EVQLVQSGAEVKKPGSSVKVSCKASGYTFTDYEIHWVRQAPGQGLEWMGVNDPESGGTFYNQKFDGRVTLTADKSTSTAYMELSSLRSEDTAVYYCTRYDRWDSFNGMDEWGQGTTVTVSS |
| J439M1S2(H)R4-D3VH | 271 | EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKWESFNGMDYWGQGTTVTVSS |
| J439M1S2(H)R4-D4VH | 272 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYWKWDSFYGMDSWGQGTTVTVSS |
| J439M1S2(H)R4-D5VH | 273 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWDSFYGMDYWGQGTTVTVSS |
| J439M1S2(H)R4-D6VH | 274 | EVQLVQSGAEVKKPGSSVKVSCKASGYTFDDYEIHWVRQAPGQGLEWIGVNDPESGGTLYNQKFDGRVTITADESTSTAYMELSSLRSEDTAVYYCTRYDKWESFSGMDYWGQGTTVTVSS |
| J439M1S2(H)R4-D8VH | 275 | EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWYSFEGMDIWGQGTTVTVSS |
| J439M1S2(H)R4-D9VH | 276 | EVQLVQSGAEVKKPGSSVKVSCKASGYTFDDYEIHWVRQAPGQGLEWMGVNDPESGGTMYNQKFDGRVTLTADKSTSTAYMELSSLRSEDTAVYYCTRYDKWDSFYGMDCWGQGTTVTVSS |
| J439M1S2(H)R5-E11VH | 277 | EVQLVQSWAEVKKPGSSVKVSCKASGYTFTEYEIHWVRQAPGQGLEWIGVNDPESGGTFYNQKFDGRVTLTADKSTSTAYMELSSLRSEDTAVYYCTRYDKWESFNGMDYWGQGTTVTVSS |
| J439M1S2(H)R5-E1VH | 278 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWDSFYGMDCWGQGTTVTVSS |
| J439M1S2(H)R5-E2VH | 279 | EVQLVQSGAEVKKPGSSVKVSCKASGYTFDDYEIHWVRQAPGQGLEWMGVIDPESGGTLYNQKFDGRATLTADKSTSTAYMELSSLRSEDTAVYYCTRYDKWDSFYGMDYWGQGTTVTVSS |
| J439M1S2(H)R5-E3VH | 280 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYFKWDSFEGMDYWGQGTTVTVSS |

TABLE 8-continued

List of amino acid sequences of affinity matured h10F7 VH variants

| Clone | SEQ ID NO: | VH |
|---|---|---|
| J439M1S2(H)R5-E4VH | 281 | EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYWKFDSFYGMDLWGQGTTVTVSS |
| J439M1S2(H)R5-E6VH | 282 | EVQLVQSGAEVKKPGSPVKVSCKASGYTFTDYEIHWVRQAPGQGLEWIGVNDPDSGGTLYNQKFDGRVTLTADESTSTAYMELSSLRSEDTAVYYCTRYDKFWSFNGMDYWGQGTTVTVSS |
| J439M1S2(H)R5-E7VH | 283 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKWESFNGMDYWGQGTTVTVSS |
| J439M1S2(H)R5-E9VH | 284 | EVQLVQSGAEVKKPGSSVKVSCKASGYTFTDYEIHWVRQAPGQGLEWIGVNDPESGGTFYNQKFDGRVTLTADKSTSTAYMELSSLRSEDTAVYYCTRYDKWDSFYGMDYWGQGTTVTVSS |
| J439M1S2(H)R5-F11VH | 285 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWESFNGMDYWGQGTTVTVSS |
| J439M1S2(H)R5-F2VH | 286 | EVQLVQSGAEVKKPGSSVKVSCKASGYTFDDYEIHWVRQAPGQGLEWIGVNDPESGGTLYNQKFDGRVTITADKSTSTAYMELSSLRSEDTAVYYCTRYEKWDSFNGMDYWGQGTTVTVSS |
| J439M1S2(H)R5-F3VH | 287 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKYWSFEGMDYWGQGTTVTVSS |
| J439M1S2(H)R5-F4VH | 288 | EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYSKWDSFQGMDYWGQGTTVTVSS |
| J439M1S2(H)R5-F6VH | 289 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWESFAGMDYWGQGTTVTVSS |
| J439M1S2(H)R5-F8VH | 290 | EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKYWSFNGMDYWGQGTTVTVSS |
| J439M1S2(H)R5-F9VH | 291 | EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWESFNGMDYWGQGTTVTVSS |
| J439M1S2(H)R5-G10VH | 292 | EVQLVQSGAEVKKPGSSVKVSCKASGYTFDDYEIHWVRQAPGQGLEWMGVNDPESGGTLYNQKFDGRVTITADKSTSTAYMELSSLRSEDTAVYYCTRYYKYWSFLGMDYWGQGTTVTVSS |
| J439M1S2(H)R5-G12VH | 293 | EVQLVQSGAEVKKPGSSVKVSCKASGYTFEDYEIHWVRQAPGQGLEWIGVNDPESGGTFYNQKFDGRATLTADKSTSTAYMELSSLRSEDTAVYYCTRYDKWDSFYGMDYWGQGTTVTVSS |
| J439M1S2(H)R5-G1VH | 294 | EVQLVQSGAEVKKPGSSVKVSCKASGYTFTDYEIHWVRQAPGQGLEWMGVNDPESGGTLYNQKFDGRVTITADKSTSTAYMELSSLRSEDTAVYYCTRYDKWDSFYGMDYWGQGTTVTVSS |
| J439M1S2(H)R5-G2VH | 295 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWESFAGMDYWGQGTTVTVSS |

TABLE 8-continued

List of amino acid sequences of affinity matured h10F7 VH variants

| Clone | SEQ ID NO: | VH |
|---|---|---|
| J439M1S2(H)R5-G3VH | 296 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYSKWDSFQGMDYWGQGTTVTVSS |
| J439M1S2(H)R5-G4VH | 297 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKWDSFYGMDYWGQGTTVTVSS |
| J439M1S2(H)R5-G7VH | 298 | EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKWESFNGMDYWGQGTTVTVSS |
| J439M1S2(H)R5-G9VH | 299 | EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKWDSFYGMDCWGQGTTVTVSS |
| J439M1S2(H)R5-H11VH | 300 | EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDRWDSFNGMDEWGQGTTVTVSS |
| J439M1S2(H)R5-H12VH | 301 | EVQLVQSGAEVKKPGSSVKVSCKASGYTFTDYEIHWVRQAPGQGLEWMGVNDPESGGTLYNQKFDGRVTITADESTSTAYMELSSLRSEDTAVYYCTRYDKWYSFEGMDIWGQGTTVTVSS |
| J439M1S2(H)R5-H1VH | 302 | EVQLVQSGAEVKKPGSSVKVSCKASGYTFTDYEIHWVRQAPGQGLEWIGVNDPESGGTFYNQKFDGRATLTADESTSTAYMELSSLRSEDTAVYYCTRYDKWDSFYGMDYWGQGTTVTVSS |
| J439M1S2(H)R5-H2VH | 303 | EVQLVQSGAEVKKPGSSVKVSCKASGYTFNDYEIHWVRQAPGQGLEWMGVIDPESGGTLYNQKFDGRATITADESTSTAYMELSSLRSEDTAVYYCTRYDKWYSFEGMDIWGQGTTVTVSS |
| J439M1S2(H)R5-H3VH | 304 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFLGMDYWGQGTTVTVSS |
| J439M1S2(H)R5-H4VH | 305 | EVQLVQSGAEVKKPGSSVKVSCKASGYTFADYEIHWVRQAPGQGLEWIGVNDPESGGTFYNQKFDGRATLTADESTSTAYMELSSLRSEDTAVYYCTRYDKWDSFYGMDCWGQGTTVTVSS |
| J439M1S2(H)R5-H8VH | 306 | EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYWSFYGMDYWGQGTTVTVSS |
| J439M1S2(H)R5-H9VH | 307 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKFWSFNGMDYWGQGTTVTVSS |
| J439M1S2-11VH | 308 | EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWESFNGMDYWGQGTTVTVSS |
| J439M1S2-32VH | 309 | EVQLVQSGAEVKKPGSSVKVSCKASGYTFEDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| J439M1S2-34VH | 310 | EVQLVQSGAEVKKPRSSVKVSCKASGYTFDDYEIHWVRQAPGQGLEWIGVNDPESGGTFYNQKFDGRATLTADKSTSTAYMELSSLRSEDTAVYYCTRYDKWESFNGMDYWGQGTTVTISS |

TABLE 8-continued

List of amino acid sequences of affinity matured h10F7 VH variants

| Clone | SEQ ID NO: | VH |
|---|---|---|
| J439M1S2-39VH | 311 | EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWESFDGMDYWGQGTTVTVSS |
| J439M1S2-7VH | 312 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| J439M1S2-9VH | 313 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWESFSGMDHWGQGTTVTVSS |
| J439M1S3R4-38VH | 314 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| J439M1S3R4-46VH | 315 | EVQLVQSGAEETKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| J439M1S3R4-4VH | 316 | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| J439M1S3R5-15VH | 317 | EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWDSFYGMDYWGQGTTVTVSS |

Table 9 provides a list of amino acid sequences of VL regions of affinity matured fully human IL-17 antibodies derived from h10F7 Amino acid residues of individual CDRs of each VH sequence are indicated in bold.

TABLE 9

List of amino acid sequences of affinity matured h10F7 VL variants

| Clone | SEQ ID NO: | VL |
|---|---|---|
| J417M2S2-37Vk | 318 | DIQMTQSPSSLSASVGDRVTITCSASSSISYIYWFQQKPGKSPKLWIYATFELASGVPSRFSGSGSGTDYTLTISSLQPEDFATYYCHQRSSYPWTFGQGTKLEIK |
| J417M2S2-46Vk | 319 | DIQMTQSPSSLSASVGDRVTITCSASSSISYIYWFQQKPGKSPKRWIYATFELASGVPSRFSGSGSGTDYTLTISSLQPEDFATYYCQQRSSYPWTFGQGTKLEIK |
| J417M2S2-72Vk | 320 | DIQMTQSPSSLSASVGDRVTITCSASSSISYIYWFQQKPGKSPKRWIYATFELASGVPSRFSGSGSGTDYTLTISSLQPEDFATYYCNQRSSYPWTFGQGTKLEIK |
| J417M2S2-96Vk | 321 | DIQMTQSPSSLSASVGDRVTITCSASSSISYIYWFQQKPGKSPKRWIYATFELASGVPSRFSGSGSGTDYTLTISSLQPEDFATYYCHQRSSYPWTFGQGTKLEIK |
| J417M2S3-12Vk | 322 | DIQMTQSPSSLSASVGDRVTITCSASSSISYIYWFQQKPGKAPKRLIYATSELASGVPSRFSGSGSGTDYTLTISSLQPEDFATYYCHQRSSYPFTFGQGTKLEIK |
| J417M2S3-3Vk | 323 | DIQMTQSPSSLSASVGDRVTITCSASSSVRYIYWFQQKPGKSPKRLIYATSDLASGVPSRFSGSGSGTDFTLTISSLQPEDFATYYCHQRSSYPFTFGQGTKLEIK |
| J417M2S3-83Vk | 324 | DIQMTQSPSSLSASVGDRVTITCSASSSISYIYWFQQKPGKSPKRWIYATSELASGVPSRFSGSGSGTDYTLTISSLQPEDFATYYCHQRSSYPWTFGQGTKLEIK |

TABLE 9-continued

List of amino acid sequences of affinity matured h10F7 VL variants

| Clone | SEQ ID NO: | VL |
|---|---|---|
| J417M2S3-86Vk | 325 | DIQMTQSPSSLSASVGDRVTITCSASSSISYIYWFQQKPGKAPKRLIYATSELASGVPSRFSGSGSGTDYTLTISSLQPEDFATYYCHQRSSYPWTFGQGTKLEIK |
| J420M2S2-32Vk | 326 | DIQMTQSPSSLSASVGDRVTITCSASSSISYIYWFQQKPGKSPKRWIYATFELASGVPSRFSGSGSGTDYTLTISSLQPEDFATYYCHQRSSYPWTFGQGTKLEIK |
| J420M2S2-91Vk | 327 | DIQMTQSPSSLSASVGDRVTITCSASSSISYIYWFQQKPGKSPKRWIYATFELASGVPSRFSGSGSGTDYTLTISSLQPEDFATYYCHQRSSYPWTFGQGTKLEIK |
| J420M2S3-32Vk | 328 | DIQMTQSPSSLSASVGDRVTITCSASSSISYIYWFQQKPGKSPKRWIYATFELASGVPSRFSGSGSGTDYTLTISSLQPEDFATYYCHQRSSYPWTFGQGIKLEIK |
| J425M2S2-13Vk | 329 | DIQMTQSPSSLSASVGDRVTITCSASQSVSYIYWFQQKPGKAPKRLIYATSELASGVPSRFSGSGSGTDYTLTISSLQPEDFATYYCHQRSYYPLTFGQGTKLEIK |
| J425M2S2-15Vk | 330 | DIQMTQSPSSLSASVGDRVTITCSASSIINYIYWFQQKPGKAPKRLIYATSELASGVPSRFSGSGSGTDYTLTISSLQPEDFATYYCHQRSSYPPTFGQGTKLEIK |
| J425M2S2-17Vk | 331 | DIQMTQSPSSLSASVGDRVTITCSASQSISPIYWFQQKPGKAPKRLIYTTSELASGVPSRFSGSGSGTDYTLTISSLQPEDFATYYCQQRSSYPITFGQGTKLEIK |
| J425M2S2-18Vk | 332 | DIQMTQSPSSLSASVGDRVTITCRASQSISYLYWFQQKPGKSPKRLIYATSELASGVPSRFSGSGSGTDYTLTISSLQPEDFATYYCQQRSSYPLTFGQGTKLEIK |
| J425M2S2-19Vk | 333 | DIQMTQSPSSLSASVGDRVTITCSASSIISYIYWFQQKPGKAPKRLIYTTFELASGVPSRFSGSGSGTDYTLTISSLQPEDFATYYCNQRSSYPYTFGQGTKLEIK |
| J425M2S2-1Vk | 334 | DIQMTQSPSSLSASVGDRVTITCRASQSISYLYWFQQKPGKAPKRLIYATSELASGVPSRFSGSGSGTDFTLTISSLQPEDFATYYCQQRRIYPPTFGQGTKLEIK |
| J425M2S2-20Vk | 335 | DIQMTQSPSSLSASVGDRVTITCSASSSIRYIYWFQQKPGKAPKRLIYATFELASGVPSRFSGSGSGTDFTLTISSLQPEDFATYYCQQRSSYPLTFGQGTKLEIK |
| J425M2S2-22Vk | 336 | DIQMTQSPSSLSASVGDRVTITCRASQSISYLYWFQQKPGKSPKRWIYATSELASGVPSRFSGSGSGTDFTLTISSLQPEDFATYYCQQRSNYPLTFGQGTKLEIK |
| J425M2S2-23Vk | 337 | DIQMTQSPSSLSASVGDRVTITCSASQSISYIYWFQQKPGKSPKRLIYATSELASGVPSRFSGSGSGTDYTLTISSLQPEDFATYYCQQRSSYPYTFGQGTKLEIK |
| J425M2S2-24Vk | 338 | DIQMTQSPSSLSASVGDRVTITCRASSSISYLYWFQQKPGKAPKRWIYGTFELASGVPSRFSGSGSGTDYTLTISSLQPEDFATYYCQQRSSYPYTFGQGTKLEIK |
| J425M2S2-27Vk | 339 | DIQMTQSPSSLSASVGDRVTITCRASSSISYLYWFQQKPGKSPKRWIYATSELASGVPSRFSGSGSGTDFTLTISSLQPEDFATYYCQQRSSYPLTFGQGTKLEIK |
| J425M2S2-28Vk | 340 | DIQMTQSPSSLSASVGDRVTITCSASQSLTYIYWFQQKPGKAPKRLIYATSELASGVPSRFSGSGSGTDFTLTISSLQPEDFATYYCQQRSSYPPTFGQGTKLEIK |
| J425M2S2-2Vk | 341 | DIQMTQSPSSLSASVGDRVTITCSASQSISYLYWFQQKPGKAPKRLIYATSELASGVPSRFSGSGSGTDFTLTISSLQPEDFATYYCQQRSSYPLTFGQGTKLEIK |
| J425M2S2-31Vk | 342 | DIQMTQSPSSLSASVGDRVTITCSASSSIRYIYWFQQKPGKAPKRLIYETSDLQSGVPSRFSGSGSGTDFTLTISSLQPEDFATYYCQQRSYYPLTFGQGTKLEIK |
| J425M2S2-32Vk | 343 | DIQMTQSPSSLSASVGDRVTITCSASSSISYIYWFQQKPGKSPKRLIYSTFELQSGVPSRFSGSGSGTDFTLTISSLQPEDFATYYCQQRSFYPLTFGQGTKLEIK |

TABLE 9-continued

List of amino acid sequences of affinity matured h10F7 VL variants

| Clone | SEQ ID NO: | VL |
|---|---|---|
| J425M2S2-33Vk | 344 | DIQMTQSPSSLSASVGDRVTITCSASSIISYIYWFQQKPGKSPKRLIYATSELASGVPSRFSGSGSGTDYTLTISSLQPEDFATYYCHQRSWYPLTFGQGTKLEIK |
| J425M2S2-36Vk | 345 | DIQMTQSPSSLSASVGDRVTITCSASSSIRYIYWFQQKPGKAPKRLIYATSELASGVPSRFSGSGSGTDFTLTISSLQPEDFATYYCQQRSSYPLTFGQGTKLEIK |
| J425M2S2-37Vk | 346 | DIQMTQSPSSLSASVGDRVTITCSASQSIRYLYWFQQKPGKSPKRLIYATSELASGVPSRFSGSGSGTDFTLTISSLQPEDFATYYCHQRTRYPFTFGQGTKLEIK |
| J425M2S2-38Vk | 347 | DIQMTQSPSSLSASVGDRVTITCRASSSISYLYWFQQKPGKSPKRLIYSTSGLASGVPSRFSGSGSGTDYTLTISSLQPEDFATYYCNQRSYYPITFGQGTKLEIK |
| J425M2S2-39Vk | 348 | DIQMTQSPSSLSASVGDRVTITCRASSIISYIYWFQQKPGKAPKRWIYATSELASGVPSRFSGSGSGTDYTLTISSLQPEDFATYYCQQRSTYPLTFGQGTKLEIK |
| J425M2S2-3Vk | 349 | DIQMTQSPSSLSASVGDRVTITCSASSSVSYIYWFQQKPGKAPKRWIYATSELASGVPSRFSGSGSGTDFTLTISSLQPEDFATYYCQQRSSYPLTFGQGTKLEIK |
| J425M2S2-40Vk | 350 | DIQMTQSPSSLSASVGDRVTITCSASSIISYIYWFQQKPGKAPKRLIYATSELASGVPSRFSGSGSGTDYTLTISSLQPEDFATYYCHQRSSYPYTFGQGTKLEIK |
| J425M2S2-41Vk | 351 | DIQMTQSPSSLSASVGDRVTITCSASSIMNYIYWFQQKPGKAPKRWIYATSELASGVPSRFSGSGSGTDFTLTISSLQPEDFATYYCVQWSLYPPTFGQGTKLEIK |
| J425M2S2-43Vk | 352 | DIQMTQSPSSLSASVGDRVTITCSASQSIGYLYWFQQKPGKAPKRLIYATSELASGVPSRFSGSGSGTDFTLTISSLQPEDFATYYCQQRSSYPLTFGQGTKLEIK |
| J425M2S2-44Vk | 353 | DIQMTQSPSSLSASVGDRVTITCRASSIISYIYWFQQKPGKAPKRWIYATFELASGVPSRFSGSGSGTDYTLTISSLQPEDFATYYCHQRSSYPCTFGQGTKLEIK |
| J425M2S2-45Vk | 354 | DIQMTQSPSSLSASVGDRVTITCRASSSISYLYWFQQKPGKAPKRLIYATSELASGVPSRFSGSGSGTDFTLTISSLQPEDFATYYCHQRSRYPFTFGQGTKLEIK |
| J425M2S2-46Vk | 355 | DIQMTQSPSSLSASVGDRVTITCSASSSISYLYWFQQKPGKSPKRWIYATSELASGVPSRFSGSGSGTDFTLTISSLQPEDFATYYCHQRSSYPWTFGQGTKLEIK |
| J425M2S2-47Vk | 356 | DIQMTQSPSSLSASVGDRVTITCSASSSIRYIYWFQQKPGKAPKRWIYATSELASGVPSRFSGSGSGTDFTLTISSLQPEDFATYYCQQRSSYPYTFGQGTKLEIK |
| J425M2S2-48Vk | 357 | DIQMTQSPSSLSASVGDRVTITCRASSSISYIYWFQQKPGKSPKRWIYATSELASGVPSRFSGSGSGTDYTLTISSLQPEDFATYYCQQRSSYPITFGQGTKLEIK |
| J425M2S2-4Vk | 358 | DIQMTQSPSSLSASVGDRVTITCRASQSISYLYWFQQKPGKSPKRLIYATSELASGVPSRFSGSGSGTDFTLTISSLQPEDFATYYCHQRSSYPYTFGQGTKLEIK |
| J425M2S2-51Vk | 359 | DIQMTQSPSSLSASVGDRVTITCSASSSISYLYWFQQKPGKAPKRLIYATSELASGVPSRFSGSGSGTDYTLTISSLQPEDFATYYCNQRSSYPYTFGQGTKLEIK |
| J425M2S2-52Vk | 360 | DIQMTQSPSSLSASVGDRVTITCSASQSISYIYWFQQKPGKAPKRWIYATSELASGVPSRFSGSGSGTDFTLTISSLQPEDFATYYCNQRSSYPYTFGQGTKLEIK |
| J425M2S2-53Vk | 361 | DIQMTQSPSSLSASVGDRVTITCSASQIIGYIYWFQQKPGKAPKRWIYATSELASGVPSRFSGSGSGTDYTLTISSLQPEDFATYYCQQRSSYPLTFGQGTKLEIK |
| J425M2S2-55Vk | 362 | DIQMTQSPSSLSASVGDRVTITCSASQSINYIDWFQQKPGKAPKRWIYATFELASGVPSRFSGSGSGTDYTLTISSLQPEDFATYYCLQRNNYPPTFGQGTKLEIK |

TABLE 9-continued

List of amino acid sequences of affinity matured h10F7 VL variants

| Clone | SEQ ID NO: | VL |
|---|---|---|
| J425M2S2-56Vk | 363 | DIQMTQSPSSLSASVGDRVTITCSASSSISYIYWFQ QKPGKSPKRLIYSTSELQSGVPSRFSGSGSGTDFTL TISSLQPEDFATYYCQQRTSYPITFGQGTKLEIK |
| J425M2S2-58Vk | 364 | DIQMTQSPSSLSASVGDRVTITCRASSSISYLYWFQ QKPGKSPKRLIYATSELQSGVPSRFSGSGSGTDYTL TISSLQPEDFATYYCQQRSSYPITFGQGTKLEIK |
| J425M2S2-59Vk | 365 | DIQMTQSPSSLSASVGDRVTITCSASSSISYLYWFQ QKPGKSPKRLIYATSELASGVPSRFSGSGSGTDFTL TISSLQPEDFATYYCQQRSLYPITFGQGTKLEIK |
| J425M2S2-5Vk | 366 | DIQMTQSPSSLSASVGDRVTITCSASQSVRYIYWFQ QKPGKAPKRWIYETSELASGVPSRFSGSGSGTDFTL TISSLQPEDFATYYCQQRSSYPLTFGQGTKLEIK |
| J425M2S2-60Vk | 367 | DIQMTQSPSSLSASVGDRVTITCRASSSISYLYWFQ QKPGKSPKRLIYTTFDLASGVPSRFSGSGSGTDFTL TISSLQPEDFATYYCQQRSSYPWTFGQGTKLEIK |
| J425M2S2-61Vk | 368 | DIQMTQSPSSLSASVGDRVTITCSASQSISYIYWFQ QKPGKAPKRLIYSTSELQSGVPSRFSGSGSGTDFTL TISSLQPEDFATYYCQQRSSYPITFGQGTKLEIK |
| J425M2S2-62Vk | 369 | DIQMTQSPSSLSASVGDRVTITCSASSSISYIYWFQ QKPGKAPKRWIYATSELASGVPSRFSGSGSGTDYTL TISSLQPEDFATYYCQQRSSYPLTFGQGTKLEIK |
| J425M2S2-64Vk | 370 | DIQMTQSPSSLSASVGDRVTITCSASSSISYLYWFQ QKPGKSPKRLIYATFELASGVPSRFSGSGSGTDFTL TISSLQPEDFATYYCQQRSSYPLTFGQGTKLEIK |
| J425M2S2-65Vk | 371 | DIQMTQSPSSLSASVGDRVTITCSASQIMSYIYWFQ QKPGKAPKRWIYATSELASGVPSRFSGSGSGTDYTL TISSLQPEDFATYYCQQRSSYPITFGQGTKLEIK |
| J425M2S2-67Vk | 372 | DIQMTQSPSSLSASVGDRVTITCSASQIINDLFWFQ QKPGKAPKRLIYDTFDLQSGVPSRFSGSGSGTDFTL TISSLQPEDFATYYCQQRTHYPITFGQGTKLEIK |
| J425M2S2-6Vk | 373 | DIQMTQSPSSLSASVGDRVTITCRASQSISYIYWFQ QKPGKAPKRWIYATFELASGVPSRFSGSGSGTDYTL TISSLQPEDFATYYCQQRSSYPLTFGQGTKLEIK |
| J425M2S2-71Vk | 374 | DIQMTQSPSSLSASVGDRVTITCSASQSISYIYWFQ QKPGKAPKRLIYGTFDLASGVPSRFSGSGSGTDYTL TISSLQPEDFATYYCQQRSSYPITFGQGTKLEIK |
| J425M2S2-72Vk | 375 | DIQMTQSPSSLSASVGDRVTITCSASSSISYLYWFQ QKPGKAPKRWIYATSELASGVPSRFSGSGSGTDFTL TISSLQPEDFATYYCAQRGYPYTFGQGTKLEIK |
| J425M2S2-73Vk | 376 | DIQMTQSPSSLSASVGDRVTITCRASQSIRYIYWFQ QKPGKSPKRWIYATSELASGVPSRFSGSGSGTDYTL TISSLQPEDFATYYCQQRSSYPYTFGQGTKLEIK |
| J425M2S2-75Vk | 377 | DIQMTQSPSSLSASVGDRVTITCRASQSLSYIYWFQ QKPGKAPKRWIYATSELASGVPSRFSGSGSGTDYTL TISSLQPEDFATYYCHQRNFYPLTFGQGTKLEIK |
| J425M2S2-76Vk | 378 | DIQMTQSPSSLSASVGDRVTITCSASQIISYIYWFQ QKPGKAPKRLIYGTSQLASGVPSRFSGSGSGTDFTL TISSLQPEDFATYYCQQRSRYPLTFGQGTKLEIK |
| J425M2S2-77Vk | 379 | DIQMTQSPSSLSASVGDRVTITCSASQSISYIYWFQ QKPGKAPKRLIYATSDLQSGVPSRFSGSRSGTDFTL TISSLQPEDFATYYCQQRSSYPLTFGQGTKLEIK |
| J425M2S2-78Vk | 380 | DIQMTQSPSSLSASVGDRVTITCRASQSISYIYWFQ QKPGKAPKRLIYATSELASGVPSRFSGSGSGTDFTL TISSLQPEDFATYYCQQRSLYPLTFGQGTKLEIK |
| J425M2S2-82Vk | 381 | DIQMTQSPSSLSASVGDRVTITCRASQSLSYIYWFQ QKPGKSPKRWIYATSELASGVPSRFSGSGSGTDYTL TISSLQPEDFATYYCHQRSWYPLTFGQGTKLEIK |

TABLE 9-continued

List of amino acid sequences of affinity
matured h10F7 VL variants

| Clone | SEQ ID NO: | VL |
|---|---|---|
| J425M2S2-83Vk | 382 | DIQMTQSPSSLSASVGDRVTITCRASSSINYLYWFQQKPGKSPKRLIYATFELASGVPSRFSGSGSGTDYTLTISSLQPEDFATYYCNQRSNYPYTFGQGTKLEIK |
| J425M2S2-84Vk | 383 | DIQMTQSPSSLSASVGDRVTITCRASSIINYIYWFQQKPGKAPKRWIYATSELASGVPSRFSGSGSGTDYTLTISSLQPEDFATYYCQQRSIYPLTFGQGTKLEIK |
| J425M2S2-85Vk | 384 | DIQMTQSPSSLSASVGDRVTITCRASSSISYIYWFQQKPGKAPKRWIYATSELASGVPSRFSGSGSGTDFTLTISSLQPEDFATYYCQQRSIYPITFGQGTKLEIK |
| J425M2S2-86Vk | 385 | DIQMTQSPSSLSASVGDRVTITCSASSSISYIYWFQQKPGKSPKRWIYATSLLASGVPSRFSGSGSGTDFTLTISSLQPEDFATYYCLQRSRYPPTFGQGTKLEIK |
| J425M2S2-87Vk | 386 | DIQMTQSPSSLSASVGDRVTITCRASSIISYIDWYQQKPGKAPKRWIYATFELASGVPSRFSGSGSGTDYTLTISSLQPEDFATYYCLQRSIYPPTFGQGTKLEIK |
| J425M2S2-89Vk | 387 | DIQMTQSPSSLSASVGDRVTITCRASSSISYLYWFQQKPGKAPKRLIYATSELASGVPSRFSGSGSGTDFTLTISSLQPEDFATYYCQQRSIYPLTFGQGTKLEIK |
| J425M2S2-8Vk | 388 | DIQMTQSPSSLSASVGDRVTITCSASSSLSYIYWFQQKPGKAPKRWIYATSELASGVPSRFSGSGSGTDYTLTISSLQPEDFATYYCQQRSNYPITFGQGTKLEIK |
| J425M2S2-93Vk | 389 | DIQMTQSPSSLSASVGDRVTITCRASSILSYIYWFQQKPGKAPKRLIYATSELASGVPSRFSGSGSGTDFTLTISSLQPEDFATYYCQQRSSYPWTFGQGTKLEIK |
| J425M2S2-96Vk | 390 | DIQMTQSPSSLSASVGDRVTITCSASSSISYIYWFQQKPGKSPKRLIYATSELASGVPSRFSGSGSGTDYTLTISSLQPEDFATYYCQQRSSYPLTFGQGTKLEIK |
| J425M2S2-9Vk | 391 | DIQMTQSPSSLSASVGDRVTITCSASSSISYLYWFQQKPGKAPKRLIYATSELASGVPSRFSGSGSGTDYTLTISSLQPEDFATYYCQQRSIYPLTFGQGTKLEIK |
| J425M2S3-10Vk | 392 | DIQMTQSPSSLSASVGDRVTITCSASSSISYIYWFQQKPGKSPKRWIYATSELASGVPSRFSGSGSGTDFTLTISSLQPEDFATYYCQQRSNYPPTFGQGTKLEIK |
| J425M2S3-11Vk | 393 | DIQMTQSPSSLSASVGDRVTITCSASQIISYLYWFQQKPGKAPKRLIYATSELASGVPSRFSGSGSGTDYTLTISSLQPEDFATYYCQQRSTYPLTFGQGTKLEIK |
| J425M2S3-12Vk | 394 | DIQMTQSPSSLSASVGDRVTITCRASSSISYIYWFQQKPGKSPKRLIYATFELASGVPSRFSGSGSGTDFTLTISSLQPEDFATYYCQQRSSYPITFGQGTKLEIK |
| J425M2S3-13Vk | 395 | DIQMTQSPSSLSASVGDRVTITCSASQSVSYIYWFQQKPGKAPKRWIYDTSELASGVPSRFSGSGSGTDFTLTISSLQPEDFATYYCLQQSIYPPTFGQGTKLEIK |
| J425M2S3-14Vk | 396 | DIQMTQSPSSLSASVGDRVTITCRASSSISYIYWFQQKPGKAPKRLIYATFELASGVPSRFSGSGSGTDYTLTISSLQPEDFATYYCHQRSFYPYTFGQGTKLEIK |
| J425M2S3-15Vk | 397 | DIQMTQSPSSLSASVGDRVTITCSASSSISYISWFQQKPGKSPKRWIYATSELASGVPSRFSGSGSGTDYTLTISSLQPEDFATYYCLQTAIYPPTFGQGTKLEIK |
| J425M2S3-16Vk | 398 | DIQMTQSPSSLSASVGDRVTITCSASSSISYIYWFQQKPGKAPKRLIYATSELASGVPSRFSGSGSGTDFTLTISSLQPEDFATYYCNQRSSYPFTFGQGTKLEIK |
| J425M2S3-17Vk | 399 | DIQMTQSPSSLSASVGDRVTITCRASQSVNYIYWFQQKPGKAPKRWIYATSELQSGVPSRFSGSGSGTDFTLTISSLQPEDFATYYCQQRSFYPLTFGQGTKLEIK |
| J425M2S3-1Vk | 400 | DIQMTQSPSSLSASVGDRVTITCSASSSISYIYWFQQKPGKAPKRLIYATSELASGVPSRFSGSGSGTDYTLTISSLQPEDFATYYCHQRSSYPYTFGQGTKLEIK |

TABLE 9-continued

List of amino acid sequences of affinity matured h10F7 VL variants

| Clone | SEQ ID NO: | VL |
|---|---|---|
| J425M2S3-21Vk | 401 | DIQMTQSPSSLSASVGDRVTITCRASSSLNYIYWFQ QKPGKAPKRWIYATSELASGVPSRFSGSRSGTDFTL TISSLQPEDFATYYCQQRMYYPQTFGQGTKLEIK |
| J425M2S3-23Vk | 402 | DIQMTQSPSSLSASVGDRVTITCSASQSISYIYWFQ QKPGKAPKRLIYGTSELASGVPSRFSGSGSGTDFTL TISSLQPEDFATYYCQQRNSYPLTFGQGTKLEIK |
| J425M2S3-24Vk | 403 | DIQMTQSPSSLSASVGDRVTITCSASSSISYIYWFQ QKPGKAPKRLIYATSELASGVPSRFSGSGSGTDFTL TISSLQPEDFATYYCQQRSSYPPTFGQGTKLEIK |
| J425M2S3-27Vk | 404 | DIQMTQSPSSLSASVGDRVTITCSASSSISYIYWFQ QKPGKAPKRLIYATFELASGVPSRFSGSGSGTDFTL TISSLQPEDFATYYCQQRSSYPYTFGQGTKLEIK |
| J425M2S3-29Vk | 405 | DIQMTQSPSSLSASVGDRVTITCSASQSISYIYWFQ QKPGKSPKRWIYATSELASGVPSRFSGSGSGTDYTL TISSLQPEDFATYYCQQRSSYPLTFGQGTKLEIK |
| J425M2S3-2Vk | 406 | DIQMTQSPSSLSASVGDRVTITCSASSIISYIYWFQ QKPGKAPKRLIYATSELASGVPSRFSGSGSGTDFTL TISSLQPEDFATYYCQQRSIYPLTFGQGTKLEIK |
| J425M2S3-30Vk | 407 | DIQMTQSPSSLSASVGDRVTITCRASQSISYLYWFQ QKPGKAPKRLIYATSELASGVPSRFSGSGSGTDFTL TISSLQPEDFATYYCQQRSSYPYTFGQGTKLEIK |
| J425M2S3-33Vk | 408 | DIQMTQSPSSLSASVGDRVTITCRASSSISYIYWFQ QKPGKSPKRLIYATSELASGVPSRFSGSGSGTDYTL TISSLQPEDFATYYCQQRTSYPYTFGQGTKLEIK |
| J425M2S3-34Vk | 409 | DIQMTQSPSSLSASVGDRVTITCSASSIVSYIYWFQ QKPGKAPKRWIYATSELASGVPSRFSGSGSGTDFTL TISSLQPEDFATYYCQQRSSYPLTFGQGTKLEIK |
| J425M2S3-37Vk | 410 | DIQMTQSPSSLSASVGDRVTITCSASSSISYIYWFQ QKPGKSPKRLIYPTFDLQSGVPSRFSGSGSGTDFTL TISSLQPEDFATYYCQQRSMYPITFGQGTKLEIK |
| J425M2S3-38Vk | 411 | DIQMTQSPSSLSASVGDRVTITCSASSSISYIYWFQ QKPGKSPKRLIYATSELASGVPSRFSGSGSGTDFTL TISSLQPEDFATYYCQQRSRYPITFGQGTKLEIK |
| J425M2S3-41Vk | 412 | DIQMTQSPSSLSASVGDRVTITCSASSIISYIYWFQ QKPGKSPKRLIYATSELASGVPSRFSGSGSGTDYTL TISSLQPEDFATYYCQQRSSYPYTFGQGTKLEIK |
| J425M2S3-44Vk | 413 | DIQMTQSPSSLSASVGDRVTITCSASQSIGYLYWFQ QKPGKAPKRWIYATSELASGVPSRFSGSGSGTDYTL TISSLQPEDFATYYCQQRSSYPLTFGQGTKLEIK |
| J425M2S3-46Vk | 414 | DIQMTQSPSSLSASVGDRVTITCRASSSISYIYWFQ QKPGKAPKRWIYATSELASGVPSRFSGSGSGTDFTL TISSLQPEDFATYYCQQRSNYPLTFGQGTKLEIK |
| J425M2S3-47Vk | 415 | DIQMTQSPSSLSASVGDRVTITCSASSSISYIYWFQ QKPGKAPKRWIYATSELASGVPSRFSGSGSGTDFTL TISSLQPEDFATYYCQQRSSYPLTFGQGTKLEIK |
| J425M2S3-48Vk | 416 | DIQMTQSPSSLSASVGDRVTITCSASSSISYIYWFQ QKPGKSPKRLIYATFELASGVPSRFSGSGSGTDYTL TISSLQPEDFATYYCNQRSSYPYTFGQGTKLEIK |
| J425M2S3-49Vk | 417 | DIQMTQSPSSLSASVGDRVTITCSASSSISYLYWFQ QKPGKAPKRWIYATSELASGVPSRFSGSGSGTDYTL TISSLQPEDFATYYCQQRSSYPYTFGQGTKLEIK |
| J425M2S3-4Vk | 418 | DIQMTQSPSSLSASVGDRVTITCSASSSIDYLYWFQ QKPGKAPKRWIYATSQLASGVPSRFSGSGSGTDFTL TISSLQPEDFATYYCQQRSTYPYTFGQGTKLEIK |
| J425M2S3-50Vk | 419 | DIQMTQSPSSLSASVGDRVTITCSASQSVSYIYWFQ QKPGKAPKRLIYATFELASGVPSRFSGSGSGTDFTL TISSLQPEDFATYYCQQRSSYPYTFGQGTKLEIK |

TABLE 9-continued

List of amino acid sequences of affinity matured h10F7 VL variants

| Clone | SEQ ID NO: | VL |
|---|---|---|
| J425M2S3-52Vk | 420 | DIQMTQSPSSLSASVGDRVTITCSASQSISYIYWFQQKPGKAPKRLIYATSELASGVPSRFSGSGSGTDYTLTISSLQPEDFATYYCQQRSSYPLTFGQGTKLEIK |
| J425M2S3-53Vk | 421 | DIQMTQSPSSLSASVGDRVTITCSASSSIGYIYWFQQKPGKSPKRWIYATSELASGVPSRFSGSGSGTDFTLTISSLQPEDFATYYCQQRSSYPITFGQGTKLEIK |
| J425M2S3-54Vk | 422 | DIQMTQSPSSLSASVGDRVTITCRASQIISYIYWFQQKPGKSPKRWIYATSELASGVPSRFSGSGSGTDYTLTISSLQPEDFATYYCLQRSSYPYTFGQGTKLEIK |
| J425M2S3-55Vk | 423 | DIQMTQSPSSLSASVGDRVTITCSASSSISYLYWFQQKPGKSPKRLIYETSELQSGVPSRFSGSGSGTDFTLTISSLQPEDFATYYCQQRSSYPFTFGQGTKLEIK |
| J425M2S3-57Vk | 424 | DIQMTQSPSSLSASVGDRVTITCSASQSIGYIYWFQQKPGKSPKRWIYATSELASGVPSRFSGSGSGTDYTLTISSLQPEDFATYYCQQRSSYPLTFGQGTKLEIK |
| J425M2S3-58Vk | 425 | DIQMTQSPSSLSASVGDRVTITCRASQSISYIYWFQQKPGKSPKRLIYATSELASGVPSRFSGSGSGTDYTLTISSLQPEDFATYYCQQRSSYPPTFGQGTKLEIK |
| J425M2S3-59Vk | 426 | DIQMTQSPSSLSASVGDRVTITCRASSSISYIYWFQQKPGKAPKRLIYATSDLASGVPSRFSGSGSGTDFTLTISSLQPEDFATYYCQQRSNYPITFGQGTKLEIK |
| J425M2S3-60Vk | 427 | DIQMTQSPSSLSASVGDRVTITCSASSIISYLYWFQQKPGKAPKRLIYATSELASGVPSRFSGSGSGTDYTLTISSLQPEDFATYYCQQRSIYPLTFGQGTKLEIK |
| J425M2S3-62Vk | 428 | DIQMTQSPSSLSASVGDRVTITCSASQSISYIYWFQQKPGKAPKRLIYATFELASGVPSRFSGSGSGTDFTLTISSLQPEDFATYYCQQRSIYPLTFGQGTKLEIK |
| J425M2S3-63Vk | 429 | DIQMTQSPSSLSASVGDRVTITCSASSSISYLYWFQQKPGKAPKRLIYATSELASGVPSRFSGSGSGTDFTLTISSLQPEDFATYYCNQRSSYPYTFGQGTKLEIK |
| J425M2S3-65Vk | 430 | DIQMTQSPSSLSASVGDRVTITCSASQSISYIYWFQQKPGKAPKRLIYSTFELQSGVPSRFSGSGSGTDYTLTISSLQPEDFATYYCNQRSSYPYTFGQGTKLEIK |
| J425M2S3-66Vk | 431 | DIQMTQSPSSLSASVGDRVTITCSASSSISYIYWFQQKPGKAPKRLIYATSELASGVPSRFSGSGSGTDFTLTISSLQPEDFATYYCQQRSSYPYTFGQGTKLEIK |
| J425M2S3-6Vk | 432 | DIQMTQSPSSLSASVGDRVTITCSASSSISYLYWFQQKPGKSPKRLIYATSELASGVPSRFSGSGSGTDFTLTISSLQPEDFATYYCNQRSIYPYTFGQGTKLEIK |
| J425M2S3-70Vk | 433 | DIQMTQSPSSLSASVGDRVTITCSASSSINYIYWFQQKPGKSPKRLIYATSELASGVPSRFSGSGSGTDFTLTISSLQPEDFATYYCQQRSMYPFTFGQGTKLEIK |
| J425M2S3-7Vk | 434 | DIQMTQSPSSLSASVGDRVTITCSASSSISYLYWFQQKPGKAPKRWIYATSELASGVPSRFSGSGSGTDHTLTISSLQPEDFATYYCQQRSSYPLTFGQGTKLEIK |
| J425M2S3-9Vk | 435 | DIQMTQSPSSLSASVGDRVTITCRASQSINYLYWFQQKPGKAPKRWIYATSELASGVPSRFSGSGSGTDFTLTISSLQPEDFATYYCHQQRTNYPPTFGQGTKLEIK |
| J427M2S2-10Vk | 436 | DIQMTQSPSSLSASVGDRVTITCSASSGSIPYIYWFQQKPGKAPKRLIYGTSGLQSGVPSRFSGSGSGTDFTLTISSLQPEDFATYYCQQRTSYPITFGQGTKLEIK |
| J427M2S2-11Vk | 437 | DIQMTQSPSSLSASVGDRVTITCRASSGIRRFINWFQQKPGKAPKRLIYATSELQSGVPSRFSGSGSGTDYTLTISSLQPEDFATYYCQQWSSYPWTFGQGTKLEIK |
| J427M2S2-12Vk | 438 | DIQMTQSPSSLSASVGDRVTITCSASQGSISYIYWFQQKPGKSPKRLIYETFDLQSGVPSRFSGSGSGTDFTLTISSLQPEDFATYYCQQRAIYPITFGQGTKLEIK |

TABLE 9-continued

List of amino acid sequences of affinity matured h10F7 VL variants

| Clone | SEQ ID NO: | VL |
|---|---|---|
| J427M2S2-14Vk | 439 | DIQMTQSPSSLSASVGDRVTITCSASQDSINYIYWF QQKPGKAPKRLIYSTSDLQSGVPSRFSGSGSGTDFT LTISSLQPEDFATYYCLQLSRYPPTFGQGTKLEIK |
| J427M2S2-15Vk | 440 | DIQMTQSPSSLSASVGDRVTITCSASQGSISYIYWF QQKPGKSPKRLIYETFELQSGVPSRFSGSGSGTDFT LTISSLQPEDFATYYCYQKNIYPWTFGQGTKLEIK |
| J427M2S2-18Vk | 441 | DIQMTQSPSSLSASVGDRVTITCSASQGSINYIYWF QQKPGKAPKRWIYGTSYLASGVPSRFSGSGSGTDFT LTISSLQPEDFATYYCQQRSSYPITFGQGTKLEIK |
| J427M2S2-20Vk | 442 | DIQMTQSPSSLSASVGDRVTITCRASSSISYIYWFQ QKPGKAPKRWIYATSELASGVPSRFSGSGSGTDFTL TISSLQPEDFATYYCNQRSRYPPTFGQGTKLEIK |
| J427M2S2-21Vk | 443 | DIQMTQSPSSLSASVGDRVTITCRASSSIKSYLNWF QQKPGKAPKRLIYATFELQSGVPSRFSGSGSGTDYT LTISSLQPEDFATYYCQQWRNYPWTFGQGTKLEIK |
| J427M2S2-23Vk | 444 | DIQMTQSPSSLSASVGDRVTITCRASSDSISYISWF QQKPGKAPKRWIYATSELQSGVPSRFSGSGSGTDFT LTISSLQPEDFATYYCQQPGIYPGTFGQGTKLEIK |
| J427M2S2-24Vk | 445 | DIQMTQSPSSLSASVGDRVTITCSASQGIFSYLFWY QQKPGKAPKRLIYATSELASGVPSRFSGSGSGTDYT LTISSLQPEDFATYYCQQGSRYPDTFGQGTKLEIK |
| J427M2S2-27Vk | 446 | DIQMTQSPSSLSASVGDRVTITCSASQGINNYLNWF QQKPGKSPKRWIYATSELQSGVPSRFSGSGSGTDYT LTISSLQPEDFATYYCQQWGSYPWTFGQGTKLEIK |
| J427M2S2-29Vk | 447 | DIQMTQSPSSLSASVGDRVTITCSASSDIVSYIYWF QQKPGKSPKRLIYATSGLASGVPSRFSGSGSGTDFT LTISSLQPEDFATYYCQQRSSYPITFGQGTKLEIK |
| J427M2S2-30Vk | 448 | DIQMTQSPSSLSASVGDRVTITCSASSSISYIYWFQ QKPGKAPKRLIYATSELASGVPSRFSGSGSGTDYTL TISSLQPEDFATYYCHQRSYYPLTFGQGTKLEIK |
| J427M2S2-31Vk | 449 | DIQMTQSPSSLSASVGDRVTITCRASSGSIGDLDWF QQKPGKAPKRLIYSTFWLASGVPSRFSGSGSGTDFT LTISSLQPEDFATYYCQQRSIYPPTFGQGTKLEIK |
| J427M2S2-33Vk | 450 | DIQMTQSPSSLSASVGDRVTITCSASSGSISYIYWF QQKPGKAPKRWIYATSELASGVPSRFSGSGSGTDFT LTISSLQPEDFATYYCQQRSSYPLTFGQGTKLEIK |
| J427M2S2-34Vk | 451 | DIQMTQSPSSLSASVGDRVTITCSASQGIISYIDWF QQKPGKAPKRLIYATFELASGVPSRFSGSGSGTDFT LTISSLQPEDFATYYCHQLGSYPDTFGQGTKLEIK |
| J427M2S2-35Vk | 452 | DIQMTQSPSSLSASVGDRVTITCSASSGIISSIDWF QQKPGKAPKRLIYATSELQSGVPSRFSGSGSGTDYT LTISSLQPEDFATYYCQQWMSYPLTFGQGTKLEIK |
| J427M2S2-36Vk | 453 | DIQMTQSPSSLSASVGDRVTITCSASSGSINYIYWF QQKPGKSPKRLIYSTSDLQSGVPSRFSGSGSGTDFT LTISSLQPEDFATYYCQQRSIYPITFGQGTKLEIK |
| J427M2S2-37Vk | 454 | DIQMTQSPSSLSASVGDRVTITCSASSDISSYLNWF QQKPGKSPKRLIYRTSELQSGVPSRFSGSGSGTDFT LTISSLQPEDFATYYCQQWSSYPWTFGQGTKLEIK |
| J427M2S2-39Vk | 455 | DIQMTQSPSSLSASVGDRVTITCSASSGSISYIYWF QQKPGKAPKRLIYDTFELASGVPSRFSGSGSGTDFT LTISSLQPEDFATYYCYQKKLYPWTFGQGTKLEIK |
| J427M2S2-4Vk | 456 | DIQMTQSPSSLSASVGDRVTITCSASSGSISYIYWF QQKPGKAPKRWIYATSELASGVPSRFSGSGSGTDFT LTISSLQPEDFATYYCQQRSIYPLTFGQGTKLEIK |
| J427M2S2-6Vk | 457 | DIQMTQSPSSLSASVGDRVTITCSASSDISSYLNWF QQKPGKSPKRLIYRTSELQSGVPSRFSGSGSGTDFT LTISSLQPEDFATYYCHQLGSYPDTFGQGTKLEIK |

TABLE 9-continued

List of amino acid sequences of affinity matured h10F7 VL variants

| Clone | SEQ ID NO: | VL |
|---|---|---|
| J427M2S2-7Vk | 458 | DIQMTQSPSSLSASVGDRVTITCSASSDSVSYIYWFQQKPGKAPKRLIYATSELQSGVPSRFSGSGSGTDFTLTISSLQPEDFATYYCQQRSSYPITFGQGTKLEIK |
| J427M2S2-8Vk | 459 | DIQMTQSPSSLSASVGDRVTITCSASQGSVSNIDWFQQKPGKAPKRLIYATFHLASGVPSRFSGSGSGTDFTLTISSLQPEDFATYYCLQRGSYPGTFGQGTKLEIK |
| J427M2S2-9Vk | 460 | DIQMTQSPSSLSASVGDRVTITCSASSGIISYIGWFQQKPGKAPKRLIYATSELASGVPSRFSGSGSGTDFTLTISSLQPEDFATYYCHQPGIYPGTFGQGTKLEIK |
| J427M2S3-17Vk | 461 | DIQMTQSPSSLSASVGDRVTITCSASQGIISYINWYQQKPGKAPKRLIYSTSELASGVPSRFSGSGSGTDYTLTISSLQPEDFATYYCQQQGSYPDTFGQGTKLEIK |
| J427M2S3-1Vk | 462 | DIQMTQSPSSLSASVGDRVTITCSASSGSISYLYWFQQKPGKAPKRLIYRTSELQSGVPSRFSGSGSGTDFTLTISSLQPEDFATYYCQQWSSYPWTFGQGTKLEIK |
| J427M2S3-20Vk | 463 | DIQMTQSPSSLSASVGDRVTITCSASSDISSYLNWFQQKPGKAPKRLIYPTFELQSGVPSRFSSSGSGTDFTLTISSLQPEDFATYYCLQFSIYPPTFGQGTKLEIK |
| J427M2S3-25Vk | 464 | DIQMTQSPSSLSASVGDRVTITCSASQDSIRYIYWFQQKPGKAPKRLIYATSELASGVPSRFSGSGSGTDFTLTISSLQPEDFATYYCYQGTIYPPTFGQGTKLEIK |
| J427M2S3-33Vk | 465 | DIQMTQSPSSLSASVGDRVTITCRASSGINGYIYWFQQKPGKAPKRLFYSTFELQSGVPSRFSGSGSGTDFTLTISSLQPEDFATYYCQQRSFYPLTFGQGTKLEIK |
| J427M2S3-34Vk | 466 | DIQMTQSPSSLSASVGDRVTITCSASSGIISSIDWFQQKPGKAPKRLIYDTFELASGVPSRFSGSGSGTDFTLTISSLQPEDFATYYCSQMSSYPHTFGQGTKLEIK |
| J427M2S3-37Vk | 467 | DIQMTQSPSSLSASVGDRVTITCSASSGSISYIYWFQQKPGKAPKRWIYATSELASGVPSRFSGSGSGTDFTLTISSLQPEDFATYYCQQRSSYPITFGQGTKLEIK |
| J427M2S3-38Vk | 468 | DIQMTQSPSSLSASVGDRVTITCSASSSSISYIYWFQQKPGKAPKRLIYATSELASGVPSRFSGSGSGTDFTLTISSLQPEDFATYYCQQRSRYPYTFGQGTKLEIK |
| J427M2S3-40Vk | 469 | DIQMTQSPSSLSASVGDRVTITCSASSSIISNLYWFQQKPGKAPKRWIYQTFELASGVPSRFSGSESGTDFTLTISSLQPEDFATYYCYQGSTYPPTFGQGTKLEIK |
| J427M2S3-46Vk | 470 | DIQMTQSPSSLSASVGDRVTITCSASSGSISYIYWFQQKPGKSPKRLIYATSELASGVPSRFSGSGSGTDFTLTISSLQPEDFATYYCQQRSIYPITFGQGTKLEIK |
| J427M2S3-48Vk | 471 | DIQMTQSPSSLSASVGDRVTITCSASSDISSYLNWFQQKPGKSPKRLIYRTSELQSGVPSRFSGSGSGTDFTLTISSLQPEDFATYYCHQFSSYPQTFGQGTKLEIK |
| J427M2S3-49Vk | 472 | DIQMTQSPSSLSASVGDRVTITCSASSGSISYIYWFQQKPGKAPKRWIYATSELASGVPSRFSGSGSGTDFTLTISSLQPEDFATYYCHQRSSYPYTFGQGTKLEIK |
| J427M2S3-50Vk | 473 | DIQMTQSPSSLSASVGDRVTITCSASSSSINYIYWFQQKPGKAPKRWIYATSELASGVPSRFSGSGSGTDYTLTISSLQPEDFATYYCQQRSIYPLTFGQGTKLEIK |
| J427M2S3-51Vk | 474 | DIQMTQSPSSLSASVGDRVTITCRASSGIVSYLYWFQQKPGKAPKRWIYATSELASGVPSRFSGSGSGTDYTLTISSLQPEDFATYYCQQRSSYPITFGQGTKLEIK |
| J427M2S3-56Vk | 475 | DIQMTQSPSSLSASVGDRVTITCSASSDSISYIYWFQQKPGKAPKRLIYDTFELQSGVPSRFSGSGSGTDFTLTISSLQPEDFATYYCQQRSRYPITFGQGTKLEIK |
| J427M2S3-60Vk | 476 | DIQMTQSPSSLSASVGDRVTITCSASQTSLSAIYWFQQKPGKAPKRLIYMTSELASGVPSRFSGSGSGTDYTLTISSLQPEDFATYYCYQSSRYPPTFGQGTKLEIK |

TABLE 9-continued

List of amino acid sequences of affinity matured h10F7 VL variants

| Clone | SEQ ID NO: | VL |
|---|---|---|
| J427M2S3-62Vk | 477 | DIQMTQSPSSLSASVGDRVTITCRASSGIISYLQWFQQKPGKAPKRWIYATSELASGVPSRFSGSGSGTDFTLTISSLQPEDFATYYCLQVSSYPPTFGQGTKLEIK |
| J427M2S3-65Vk | 478 | DIQMTQSPSSLSASVGDRVTITCSASSGIISSIDWFQQKPGKAPKRLIYATFALQSGVPSRFSGSGSGTDFTLTISSLQPEDFATYYCSQMSSYPHTFGQGTKLEIK |
| J427M2S3-66Vk | 479 | DIQMTQSPSSLSASVGDRVTITCRASSGSINYIYWFQQKPGKAPKRWIYATSELASGVPSRFSGSGSGTDYTLTISSLQPEDFATYYCQQRSSYPYTFGQGTKLEIK |
| J427M2S3-67Vk | 480 | DIQMTQSPSSLSASVGDRVTITCRASQDSISYIYWFQQKPGKAPKRWIYATSELASGVPSRFSGSGSGTDFTLTISSLQPEDFATYYCQQRSSYPITFGQGTKLEIK |
| J427M2S3-68Vk | 481 | DIQMTQSPSSLSASVGDRVTITCSASSDSISYIYWFQQKPGKAPKRWIYATSELASGVPSRFSGSGSGTDFTLTISSLQPEDFATYYCQQRSFYPLTFGQGTKLEIK |
| J427M2S3-69Vk | 482 | DIQMTQSPSSLSASVGDRVTITCRASQGIISYIYWFQQKPGKAPKRLIYDTSELASGVPSRFSGSGSGTDFTLTISSLQPEDFATYYCYQKSIYPWTFGQGTKLEIK |
| J427M2S3-6Vk | 483 | DIQMTQSPSSLSASVGDRVTITCSASSEIVSYIYWFQQKPGKAPKRLIYATSELASGVPSRFSGSGSGTDYTLTISSLQPEDFATYYCQQRSSYPPTFGQGTKLEIK |
| J427M2S3-71Vk | 484 | DIQMTQSPSSLSASVGDRVTITCSASQGSLRYIYWFQQKPGKAPKRWIYATSELASGVPSRFSGSGSGTDFTLTISSLQPEDFATYYCQQRSSYPLTFGQGTKLEIK |
| J427M2S3-73Vk | 485 | DIQMTQSPSSLSASVGDRVTITCRASSGSIRDLYWFQQKPGKAPKRLIYDTFELASGVPSRFSGSGSGTDYTLTISSLQPEDFATYYCYQKSTYPWTFGQGTKLEIK |
| J427M2S3-74Vk | 486 | DIQMTQSPSSLSASVGDRVTITCSASSGSINYLYWFQQKPGKAPKRLIYDTFYLASGVPSRFSGSGSGTDFTLTISSLQPEDFATYYCYQKSTYPWTFGQGTKLEIK |
| J427M2S3-75Vk | 487 | DIQMTQSPSSLSASVGDRVTITCRASQSSIRYLYWYQQKPGKAPKRLIYATSELASGVPSRFSGSGSGTDYTLTISSLQPEDFATYYCQQRDIYPPTFGQGTKLEIK |
| J427M2S3-78Vk | 488 | DIQMTQSPSSLSASVGDRVTITCSASQGIGSYIYWFQQKPGKAPKRWIYATSELASGVPSRFSGSGSGTDFTLTISSLQPEDFATYYCHQRSSYPYTFGQGTKLEIK |
| J427M2S3-80Vk | 489 | DIQMTQSPSSLSASVGDRVTITCRASSGSIRDLYWFQQKPGKAPKRWIYQTSELASGVPSRFSGSGSGTDFTLTISSLQPEDFATYYCQQVSSYPPTFGQGTKLEIK |
| J427M2S3-81Vk | 490 | DIQMTQSPSSLSASVGDRVTITCSASQASISYIYWFQQKPGKAPKRLIYDTFELQSGVPSRFSGSGSGTDFTLTISSLQPEDFATYYCQQRSSYPITFGQGTKLEIK |
| J427M2S3-84Vk | 491 | DIQMTQSPSSLSASVGDTVTITCRASQVSISYIYWFQQKPGKAPKRWIYATSELASGVPSRFSGSGSGTDFTLTISSLQPEDFATYYCQQRSSYPYTFGQGTKLEIK |
| J427M2S3-85Vk | 492 | DIQMTQSPSSLSASVGDRVTITCSASSDISSYLNWFQQKPGKSPKRLIYRTSELQSGVPSRFSGSGSGTDFTLTISSLQPEDFATYYCQQRSFYPLTFGQGTKLEIK |
| J427M2S3-87Vk | 493 | DIQMTQSPSSLSASVGDRVTITCRASSDIFSCIFWFQQKPGKAPKRLIYETFDLASGVPSRFSGSGSGTDYTLTISSLQPEDFATYYCLQWSSYPPTFGQGTKLEIK |
| J427M2S3-88Vk | 494 | DIQMTQSPSSLSASVGDRVTITCSASSGIGSYIYWFQQKPGKAPKRWIYATSELASGVPSRFSGSGSGTDFTLTISSLQPEDFATYYCHQRSSYPYTFGQGTKLEIK |
| J427M2S3-8Vk | 495 | DIQMTQSPSSLSASVGDRVTITCSASQGIKGYLNWFQQKPGKAPKRLIYATFELQSGVPSRFSGSGSGTDYTLTISSLQPEDFATYYCQQWSKYPWTFGQGTKLEIK |

TABLE 9-continued

List of amino acid sequences of affinity matured h10F7 VL variants

| Clone | SEQ ID NO: | VL |
|---|---|---|
| J427M2S3-92Vk | 496 | DIQMTQSPSSLSASVGDRVTITCSASSGSISYIDWFQQKPGKAPKRLIYATFELASGVPSRFSGSGSGTDFTLTISSLQPEDFATYYCHQFSSYPQTFGQGTKLEIK |
| J427M2S3-94Vk | 497 | DIQMTQSPSSLSASVGDRVTITCSASQGIGSYIYWFQQKPGKAPKRWIYATSELASGVPSRFSGSGSGTDFTLTISSLQPEDFATYYCYQDSRYPPTFGQGTKLEIK |
| J427M2S3-9Vk | 498 | DIQMTQSPSSLSASVGDRVTITCRASQDSIRYIYWFQQKPGKAPKRLIYATFELASGVPSRFSGSGSGTDYTLTISSLQPEDFATYYCNQRSNYPYTFGQGTKLEIK |
| J439M1S2(H)3-A12Vk | 499 | DIQMTQSPSSLSASVGDRVTITCSASSGSLSYIYWFQQKPGKAPKRWIYATSELASGVPSRFSGSGSGTDYTLTISSLQPEDFATYYCQQRSIYPYTFGQGTKLEIK |
| J439M1S2(H)3-B37Vk | 500 | DIQMTQSPSSLSASVGDRVTITCSASSGSISYIDWFQQKPGKSPKRLIYATFELASGVPSRFSGSGSGTDYTLTISSLQPEDFATYYCHQIGSYPGTFGQGTKLEIK |
| J439M1S2(H)3-B5Vk | 501 | DIQMTQSPSSLSASVGDRVTITCRASSGIISYVDWFQQKPGKAPKRLIYATFELASGVPSRFSGSGSGTDFTLTISSLQPEDFATYYCHQIGIYPRTFGQGTKLEIK |
| J439M1S2(H)3-B7Vk | 502 | DIQMTQSPSSLSASVGDRVTITCKASSGIIGYIDWFQQKPGKAPKRLIYATFDLASGVPSRFSGSGSGTDYTLTISSLQPEDFATYYCRQVGSYPETFGQGTKLEIK |
| J439M1S2(H)3-C20Vk | 503 | DIQMTQSPSSLSASVGDRVTITCRASSGINRYIDWFQQKPGKAPKRLIYATFDLASGVPSRFSGSGSGTDYTLTISSLQPEDFATYYCRQVGSYPETFGQGTKLEIK |
| J439M1S2(H)3-C5Vk | 504 | DIQMTQSPSSLSASVGDRVTITCSASQGIGSYIYWFQQKPGKAPKRWIYATSELASGVPSRFSGSGSGTDFTLTISSLQPEDFATYYCQQRSSYPITFGQGTKLEIK |
| J439M1S2(H)3-D10Vk | 505 | DIQMTQSPSSLSASVGDRVTITCSASQGIRSYIDWFQQKPGKSPKRLIYATFDLASGVPSRFSGSGSGTDYTLTISSLQPEDFATYYCRQVGNYPGTFGQGTKLEIK |
| J439M1S2(H)3-D40Vk | 506 | DIQMTQSPSSLSASVGDRVTITCSASSASVRYIDWFQQKPGKAPKRLIYATFDLASGVPSRFSGSGSGTDYTLTISSLQPEDFATYYCRQVGSYPETFGQGTKLEIK |
| J439M1S2(H)R4-A3Vk | 507 | DIQMTQSPSSLSASVGDRVTITCRASSGIRSYIDWFQQKPGKSPKRLIYATFDLASGVPSRFSGSGSGTDYTLTISSLQPEDFATYYCRQVGNYPGTFGQGTKLEIK |
| J439M1S2(H)R4-A6Vk | 508 | DIQMTQSPSSLSASVGDRVTITCSASQGSNCYLDWFQQKPGKAPKRLIYATSELASGVPSRFSSSGSGTDYTLTISSLQPEDFATYYCHQLSSYPNTFGQGTKLEIK |
| J439M1S2(H)R4-B11Vk | 509 | DIQMTQSPSSLSASVGDRVTITCSASSDINSYIDWFQQKPGKAPKRLIYATFELASGVPSRFSGSGSGTDYTLTISSLQPEDFATYYCHQLGSYPRTFGQGTKLEIK |
| J439M1S2(H)R4-D11Vk | 510 | DIQMTQSPSSLSASVGDRVTITCSASQGSISYIDWFQQKPGKAPKRLIYATFDLASGVPSRFSGSGSGTDYTLTISSLQPEDFATYYCRQVGSYPETFGQGTKLEIK |
| J439M1S2(H)R5-E2Vk | 511 | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIK |
| J439M1S2(H)R5-E6Vk | 512 | DIQMTQSPSSLSASVGDRVTITCSASSGSISYIDWFQQKPGKAPKRLIYATFELASGVPSRFSGSGSGTDYTLTISSLQPEDFATYYCRQVGSYPETFGQGTKLEIK |
| J439M1S2(H)R5-E9Vk | 513 | DIQMTQSPSSLSASVGDRVTITCSASQGIFSYIDWFQQKPGKAPKRLIYATFDLASGVPSRFSGSGSGTDYTLTISSLQPEDFATYYCRQVGSYPETFGQGTKLEIK |
| J439M1S2(H)R5-F5Vk | 514 | DIQMTQSPSSLSASVGDRVTITCSASSGSISYIDWFQQKPGKAPKRLIYATFDLASGVPSRFSSSGSGTDYTLTISSLQPEDFATYYCHQLGSYPGTFGQGTKLEIK |

TABLE 9-continued

List of amino acid sequences of affinity matured h10F7 VL variants

| Clone | SEQ ID NO: | VL |
|---|---|---|
| J439M1S2(H)R5-G10Vk | 515 | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIK |
| J439M1S2(H)R5-H2Vk | 516 | DIQMTQSPSSLSASVGDRVTITCRASSGIPSYIDWFQQKPGKAPKRLIYATFELASGVPSRFSGSGSGTDYTLTISSLQPEDFATYYCRQLGSYPRTFGQGTKLEIK |
| J439M1S2(H)R5-H4Vk | 517 | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGHGTKLEIK |
| J439M1S2-11Vk | 518 | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIK |
| J439M1S2-20Vk | 519 | DIQMTQSPSSLSASVGDRVTITCSASQGIISYIDWFQQKPGKAPKRLIYATFELASGVPSRFSGSGSGTDFTLTISSLQPEDFATYYCRQVGSYPETFGQGTKLEIK |
| J439M1S2-7Vk | 520 | DIQMTQSPSSLSVSVGDRVTITCRASSGIISYIDWFQQKPGKAPKRLIYATFDLASGVPSRFSGSGSGTDYTLTISSLQPEDFATYYCRQVGSYPETFGQGTKLEIK |
| J439M1S3R4-22Vk | 521 | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGAKLEIK |
| J439M1S3R4-9Vk | 522 | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIK |
| J439M1S3R5-10Vk | 523 | DIQMTQSPSSLSASVGDRVTITCSASSGSISYIDWFQQKPGKAPKRLIYATFELASGVPSRFSGSGSGTDFTLTISSLQPEDFATYYCHQLGSYPDTFGQGTKLEIK |
| J439M1S3R5-15Vk | 524 | DIQMTQSPSSLSASVGDRVTITCSASSGSISYIDWFQQKPGKAPKRLIYATFDLASGVPSRFSGSGSGTDYTLTISSLQPEDFATYYCRQVGSYPETFGQGTKLEIK |
| J439M1S3R5-37Vk | 525 | DIQMTQSPSSLSASVGDRVTITCRASSGIISYIDWFQQKPGKAPKRLIYATFDLASGVPSRFSGSGSGTDYTLTISSLQPEDFATYYCRQVGSYPDTFGQGTKLEIK |
| J439M1S3R5-5Vk | 526 | DIQMTQSPSSLSTSVGDRVTITCRASSGIISYIDWFQQKPGKAPKRLIYATFDLASGVPSRFSGSGSGTDYTLTISSLQPEDFATYYCRQVGSYPETFGQGTKLEIK |

TABLE 10

Amino acid residues observed in affinity matured anti-IL-17 antibody h10F7 h10f7 Heavy chain variable region (SEQ ID NO: 811)

```
h10f7VH.1  12345678901234567890123456789012345678901234567890 12a345678901
           EVQLVQSGAEVKKPGSSVKVSCKASGYTFTDYEIHWVRQAPGQGLEWIGVNDPESGGTFYNQ
                                      DE              M  I  D   SL
                                      S                           IY
                                      A                           M
                                      E
                                      N
                                      P
           23456789012345678901 2abc345678901234567890abcd1234567890123
           KFDGRATLTADKSTSTAYMELSSLRSEDTAVYYCTRYYRYESFYGMDYWGQGTTVTSS
              V I                                DKWDGLE    I
                I                                SMFW YN    C
                                                 W    Y SD  E
                                                 F    V L   L
                                                 E    N S   S
                                                 N    M Q   F
                                                 F    A     H
```

TABLE 10-continued

Amino acid residues observed in affinity matured anti-IL-17 antibody h10F7

```
                                                    R    A
                                                    F
                                                    M
                                                    K
                                                    H
``` h10f7 Light chain variable region (SEQ ID NO: 812)

```
H10f7Vk.  12345678901234567890123456789012345678901234567890123456789012345678901
1a        DIQLTQSPSSLSASVGDRVTITCSASS-SISYIYWFQQKPGKSPKRWIYATFELASGVPSR
                  M                 R        QGIRRCLD Y      A   L  R SD Q
                                    K        SVSNSVN                E  A
                                             DLVGD F                D  Y
                                           Q NTN   S                S  G
                                           A FPP   Q                G  Q
                                           I GLI   G                T  W
                                           V LDF                    Q  L
                                           T PCA                    P  H
                                           E K                      M
                                             M
          234567890123456789012345678901234567890123456a
          FSGSGSGTDYTLTISSLQPEDFATYYCHQRSSYPWTFGQGTKLEIK
                                     R VGN E
                                     Q WTI L
                                     L LMR G
                                     N MNF F
                                     Y KRT Y
                                     S FKY P
                                     V PAL I
                                     A GDM D
                                       S W R
                                       Q K H
                                       I H Q
                                       T G N
                                       D   C
```

The following were converted into IgG for further characterization.

TABLE 11

Individual Anti-IL-17 VH sequences from converted clones

| Protein region | SEQ ID NO | Sequence 12345678901234567890123456789 |
|---|---|---|
| h10f7VH.1a.g1m VH | 527 | EVQLVQSGAEVKKPGSSVKVSCKASGY TFTDYEIHWVRQAPGQGLEWIGVNDPE SGGTFYNQKFDGRATLTADKSTSTAYM ELSSLRSEDTAVYYCTRYYRYESFYGM DYWGQGTTVTSS |
| h10f7VH.1a.g1m VH | CDR-H1 Residues 31-35 of SEQ ID NO.: 527 | DYEIH |
| h10f7VH.1a.g1m VH | CDR-H2 Residues 50-66 of SEQ ID NO.: 527 | VNDPESGGTFYNQKFDG |
| h10f7VH.1a.g1m VH | CDR-H3 Residues 99-110 of SEQ ID NO.: 527 | YYRYESFYGMDY |
| J439M1S3R5 #10 VH | 528 | EVQLVQSGAEVKKPGSSVKVSCKASGY TFDDYEIHWVRQAPGQGLEWIGVNDPE SGGTFYNQKFDGRATLTADKSTSTAYM ELSSLRSEDTAVYYCTRYDKWDSFYGM DYWGQGTTVTSS |
| J439M1S3R5 #10 VH | CDR-H1 Residues 31-35 of SEQ ID NO.: 528 | DYEIH |
| J439M1S3R5 #10 VH | CDR-H2 Residues 50-66 of SEQ ID NO.: 528 | VNDPESGGTFYNQKFDG |

TABLE 11-continued

Individual Anti-IL-17 VH sequences from converted clones

| Protein region | SEQ ID NO | Sequence 12345678901234567890123456789 0 |
|---|---|---|
| J439M1S3R5 #10 VH | CDR-H3 Residues 99-110 of SEQ ID NO.: 528 | YDKWDSFYGMDY |
| J439M1S3R5 #11 VH | 529 | EVQLVQSGAEVKKPGSSVKVSCKASGY TFTDYEIHWVRQAPGQGLEWMGVNDPE SGGTFYNQKFDGRVTLADESTSTAYM ELSSLRSEDTAVYYCTRYSKWDSFDGM DYWGQGTTVTSS |
| J439M1S3R5 #11 VH | CDR-H1 Residues 31-35 of SEQ ID NO.: 529 | DYEIH |
| J439M1S3R5 #11 VH | CDR-H2 Residues 50-66 of SEQ ID NO.: 529 | VNDPESGGTFYNQKFDG |
| J439M1S3R5 #11 VH | CDR-H3 Residues 99-110 of SEQ ID NO.: 529 | YSKWDSFDGMDY |
| J439M1S2 (H)3 #A6 VH | 530 | EVQLVQSGAEVKKPGSSVKVSCKASGY TFTDYEIHWVRQAPGQGLEWIGVNDPD SGGTLYNQKFDGRVTLADESTSTAYM ELSSLRSEDTAVYYCTRYDKWYSFEGM DIWGQGTTVTSS |
| 439M1S2 (H)3 #A6 VH | CDR-H1 Residues 31-35 of SEQ ID NO.: 530 | DYEIH |
| 439M1S2 (H)3 #A6 VH | CDR-H2 Residues 50-66 of SEQ ID NO.: 530 | VNDPDSGGTLYNQKFDG |
| 439M1S2 (H)3 #A6 VH | CDR-H3 Residues 99-110 of SEQ ID NO.: 530 | YDKWYSFEGMDI |
| J439M1S2 (H)3 #A11 VH | 531 | EVQLVQSGAEVKKPGSSVKVSCKASGY TFTDYEIHWVRQAPGQGLEWIGVNDPE SGGTFYNQKFDGRVTLSADESTSTAYM ELSSLRSEDTAVYYCTRYDKYWSFEGM DYWGQGTTVTSS |
| J439M1S2 (H)3 #A11 VH | CDR-H1 Residues 31-35 of SEQ ID NO.: 531 | DYEIH |
| J439M1S2 (H)3 #A11 VH | CDR-H2 Residues 50-66 of SEQ ID NO.: 531 | VNDPESGGTFYNQKFDG |
| J439M1S2 (H)3 #A11 VH | CDR-H3 Residues 99-110 of SEQ ID NO.: 531 | YDKYWSFEGMDY |
| J439M1S2 (H)3 #A16 VH | 532 | EVQLVQSGAEVKKPGSSVKVSCKASGY TFSDYEIHWVRQAPGQGLEWMGVNDPE SGGTFYNQKFDGRVTLADESTSTAYM ELSSLRSEDTAVYYCTRYDKWYSFEGM DIWGQGTTVTSS |
| J439M1S2 (H)3 #A16 VH | CDR-H1 Residues 31-35 of SEQ ID NO.: 532 | DYEIH |
| J439M1S2 (H)3 #A16 VH | CDR-H2 Residues 50-66 of SEQ ID NO.: 532 | VNDPESGGTFYNQKFDG |
| J439M1S2 (H)3 #A16 VH | CDR-H3 Residues 99-110 of SEQ ID NO.: 532 | DKWYSFEGMDI |
| J439M1S2 (H)3 #B13 VH | 533 | EVQLVQSGAEVKKPGSSVKVSCKASGY TFSDYEIHWVRQAPGQGLEWMGVNDPE SGGTFYNQKFDGRVTLADESTSTAYM ELSSLRSEDTAVYYCTRYDKYWSFEGM DYWGQGTTVTSS |

TABLE 11-continued

Individual Anti-IL-17 VH sequences from converted clones

| Protein region | SEQ ID NO | Sequence 12345678901234567890123456789 0 |
|---|---|---|
| J439M1S2 (H)3 #B13 VH | CDR-H1 Residues 31-35 of SEQ ID NO.: 533 | DYEIH |
| J439M1S2 (H)3 #B13 VH | CDR-H2 Residues 50-66 of SEQ ID NO.: 533 | VNDPESGGTFYNQKFDG |
| J439M1S2 (H)3 #B13 VH | CDR-H3 Residues 99-110 of SEQ ID NO.: 533 | DKYWSFEGMDY |
| J439M1S2 (H)3 #B20 VH | 534 | EVQLVQSGAEVKKPGSSVKVSCKASGY TFTDYEIHWVRQAPGQGLEWMGVNDPE SGGTFYNQKFDGRVTLTADESTSTAYM ELSSLRSEDTAVYYCTRYDKWYSFEGM DIWGQGTTVTVSS |
| J439M1S2 (H)3 #B20 VH | CDR-H1 Residues 31-35 of SEQ ID NO.: 534 | DYEIH |
| J439M1S2 (H)3 #B20 VH | CDR-H2 Residues 50-66 of SEQ ID NO.: 534 | VNDPESGGTFYNQKFDG |
| J439M1S2 (H)3 #B20 VH | CDR-H3 Residues 99-110 of SEQ ID NO.: 534 | DKWYSFEGMDI |

TABLE 12

Individual clones Anti-IL-17 VL sequences

| Protein region | SEQ ID NO | Sequence 12345678901234567890123456789 0 |
|---|---|---|
| J439M1S3R5 #10 VL | 535 | DIQMTQSPSSLSASVGDRVTITCSASS GSISYIDWFQQKPGKAPKRLIYATFEL ASGVPSRFSGSGSGTDFTLTISSLQPE DFATYYCHQLGSYPDTFGQGTKLEIK |
| J439M1S3R5 #10 VL | CDR-L1 Residues 24-34 of SEQ ID NO.: 535 | SASSGSISYID |
| J439M1S3R5 #10 VL | CDR-L2 Residues 50-56 of SEQ ID NO.: 535 | ATFELAS |
| J439M1S3R5 #10 VL | CDR-L3 Residues 89-97 of SEQ ID NO.: 535 | HQLGSYPDT |
| J439M1S3R5 #11 VL | 536 | DIQMTQSPSSLSASVGDRVTITCRASS GIISYIDWFQQKPGKAPKRLIYATFDL ASGVPSRFSGSGSGTDYTLTISSLQPE DFATYYCRQVGSYPETFGQGTKLEIK |
| J439M1S3R5 #11 VL | CDR-L1 Residues 24-34 of SEQ ID NO.: 536 | RASSGIISYID |
| J439M1S3R5 #11 VL | CDR-L2 Residues 50-56 of SEQ ID NO.: 536 | ATFDLAS |
| J439M1S3R5 #11 VL | CDR-L3 Residues 89-97 of SEQ ID NO.: 536 | RQVGSYPET |

TABLE 12-continued

Individual clones Anti-IL-17 VL sequences

| Protein region | SEQ ID NO | Sequence 12345678901234567890123456789 0 |
|---|---|---|
| J427M2S3 #12 VL | 537 | DIQMTQSPSSLSASVGDRVTITCSASS GIISSIDWFQQKPGKAPKRLIYATFAL QSGVPSRFSGSGSGTDFTLTISSLQPE DFATYYCSQMSSYPHTFGQGTKLEIK |
| J427M2S3 #12 VL | CDR-L1 Residues 24-34 of SEQ ID NO.: 537 | SASSGIISSID |
| J427M2S3 #12 VL | CDR-L2 Residues 50-56 of SEQ ID NO.: 537 | ATFALQS |
| J427M2S3 #12 VL | CDR-L3 Residues 89-97 of SEQ ID NO.: 537 | SQMSSYPHT |
| J427M2S3 #27 VL | 538 | DIQMTQSPSSLSASVGDRVTITCSASS DISSYLNWFQQKPGKSPKRLIYRTSEL QSGVPSRFSGSGSGTDFTLTISSLQPE DFATYYCQQWSSYPWTFGQGTKLEIK |
| J427M2S3 #27 VL | CDR-L1 Residues 24-34 of SEQ ID NO.: 538 | SASSDISSYLN |
| J427M2S3 #27 VL | CDR-L2 Residues 50-56 of SEQ ID NO.: 538 | RTSELQS |
| J427M2S3 #27 VL | CDR-L3 Residues 89-97 of SEQ ID NO.: 538 | QQWSSYPWT |
| J439M1S2 (H)3#A6 VL | 539 | DIQMTQSPSSLSASVGDRVTITCSASQ GIRSYIDWFQQKPGKSPKRLIYATFDL ASGVPSRFSGSGSGTDYTLTISSLQPE DFATYYCRQVGNYPGT**FGQGTKLEIK |
| J439M1S2 (H)3#A6 VL | CDR-L1 Residues 24-34 of SEQ ID NO.: 539 | SASQGIRSYID |
| J439M1S2 (H)3#A6 VL | CDR-L2 Residues 50-56 of SEQ ID NO.: 539 | ATFDLAS |
| J439M1S2 (H)3#A6 VL | CDR-L3 Residues 89-97 of SEQ ID NO.: 539 | RQVGNYPGT |

TABLE 13 h10F7 affinity matured scFv clones converted to full length IgG

| ScFv clone name | HC plasmid | LC plasmid | Full length IgG (protein) name |
|---|---|---|---|
| J427 M2S3 #12 | pHybE-h10F7VH.1a.g1m | pHybE-hCk V3 J427 M2S3 #12 | h10F7-M12 |
| J427 M2S3 #27 | pHybE-h10F7VH.1a.g1m | pHybE-hCk V3 J427 M2S3 #27 | h10F7-M27 |
| J439M1S3R5#10 | pHybE-hCg1, z, non-a, mut(234, 235) V2 J439M1S3R5#10 | pHybE-hCk V3 J439M1S3R5#10 | h10F7-M10 |
| J439M1S3R5#11 | pHybE-hCg1, z, non-a, mut(234, 235) V2 J439M1S3R5#11 | pHybE-hCk V3 J439M1S3R5#11 | h10F7-M11 |
| J439M1S2(H)3 #A6 | pHybE-hCg1, z, non-a, mut(234, 235) V2 J439M1S2(H)3 #A6 | pHybE-hCk V3 J439M1S2(H)3#A6 | h10F7-A6 |
| J439M1S2(H)3 #A11 | pHybE-hCg1, z, non-a, mut(234, 235) V2 J439M1S2(H)3 #A11 | pHybE-hCk V3 J439M1S3R5#11 | h10F7-A11 |

TABLE 13-continued h10F7 affinity matured scFv clones converted to full length IgG

| ScFv clone name | HC plasmid | LC plasmid | Full length IgG (protein) name |
|---|---|---|---|
| J439M1S2(H)3 #A16 | pHybE-hCg1, z, non-a, mut(234, 235) V2 J439M1S2(H)3 #A16 | pHybE-hCk V3 J439M1S2(H)3#A6 | h10F7-A16 |
| J439M1S2(H)3 #B13 | pHybE-hCg1, z, non-a, mut(234, 235) V2 J439M1S2(H)3 #B13 | pHybE-hCk V3 J439M1S3R5#11 | h10F7-B13 |
| J439M1S2(H)3 #B20 | pHybE-hCg1, z, non-a, mut(234, 235) V2 J439M1S2(H)3 #B20 | pHybE-hCk V3 J439M1S3R5#11 | h10F7-B20 |

Functional Characterization of TNF/IL-17 DVD-Ig Proteins
IL-17 Enzyme-Linked Immunosorbent Assay Protocol (ELISA)

The following protocol is used to characterize the binding of IL-17 antibodies to human IL-17 by enzyme-linked immunosorbent assay (ELISA). An ELISA plate was coated with 50 µl per well of goat anti mouse IgG-Fc at 2 µg/ml, overnight at 4° C. The plate was washed 3 times with PBS/Tween. 50 µl Mab diluted to 1 µg/ml in PBS/0.1% BSA was added to appropriate wells and incubated for 1 hour at room temperature (RT). The plate was washed 3 times with PBS/Tween. 50 µl of serial diluted biotin-human IL-17 was added to appropriate wells and incubated for 1 hour at RT. The plate was washed 3 times with PBS/Tween. 50 µl of streptavidin-HRP diluted 1:10,000 in PBS/0.1% BSA was added to appropriate wells and incubated for 1 hour at RT. The plate was washed 3 times with PBS/Tween. 50 µl of TMB was added to appropriate wells and the reaction allowed to proceed for 1 minute. The reaction was stopped with 50 µl/well 2N $H_2SO_4$ and the absorbance read at 450 nm.

TABLE 14

Determination of binding affinity of IL-17 antibodies to human IL-17 by ELISA

| Protein name | EC50 |
|---|---|
| IL17-h10F7M10 hIgG1/K mut | 0.03 nM |
| IL17-h10F7M11 hIgG1/K mut | 0.04 nM |
| IL17-h10F7M-A6 hIgG1/K mut | 0.08 nM |
| IL17-h10F7M-A11 hIgG1/K mut | 0.04 nM |
| IL17-h10F7M-A16 hIgG1/K mut | 0.07 nM |
| IL17-h10F7M-B13 hIgG1/K mut | 0.06 nM |
| IL17-h10F7M-B20 hIgG1/K mut | 0.07 nM |

Affinity Measurement of Anti TNF/IL-17 DVD-Ig by Surface Plasmon Resonance

The binding of antibodies to purified recombinant IL-17 proteins was determined by surface plasmon resonance-based measurements with a Biacore® T200 instrument (GE Healthcare) using running HBS-EP (10 mM HEPES [pH 7.4], 150 mM NaCl, 3 mM EDTA, and 0.005% surfactant P20) containing 0.1 mg/ml BSA at 25° C. All chemicals were obtained from Biacore® AB (GE Healthcare) or otherwise from a source as described in the text. Approximately 5000 RU of goat anti-human IgG (Fcg) fragment specific polyclonal antibody (Pierce Biotechnology Inc, Rockford, Ill.) diluted in 10 mM sodium acetate (pH 4.5) was directly immobilized across a CM5 research grade biosensor chip using a standard amine coupling kit according to manufacturer's instructions and procedures at 25 µg/ml. Unreacted moieties on the biosensor surface were blocked with ethanolamine. Modified carboxymethyl dextran surface in flow-cell 2, 3 and 4 were used as a reaction surface. Modified carboxymethyl dextran with Goat IgG in flow cell 1 was used as the reference surface. For kinetic analysis, rate equations derived from the 1:1 Langmuir binding model were fitted simultaneously to association and dissociation phases of all six injections (using global fit analysis with local float for Rmax) with the use of Biacore T200 Evaluation software v.1.0. Purified antibodies were diluted in HEPES-buffered saline for capture across goat anti-human IgG specific reaction surfaces. Antibodies to be captured as ligand (1-5 µg/ml) were injected over reaction matrices at a flow rate of 50 µl/minute. Association phase was monitored for 5 minute, while dissociation phase was monitored for 10-60 min to accommodate for slower off-rates. The association and dissociation rate constants, ka (unit M-1 s-1) and kd (unit s-1) were determined under a continuous flow rate of 50 µl/minute. Rate constants were derived by making kinetic binding measurements at six different antigen concentrations ranging from 0.78 nM to 100 nM, depending on the species of IL-17 tested. The association ka, dissociation rate kd and equilibrium dissociation constant KD were calculated with the use of the same Biacore T200 Evaluation software v.1.0.

TABLE 15

| Antibody | Moniker # | Human IL-17AA | | | Cyno IL-17AA | | |
|---|---|---|---|---|---|---|---|
| | | $k_a$ | $k_d$ | $K_D$ | $k_a$ | $k_d$ | $K_D$ |
| IL17-h10F7M10 hIgG1/K mut | PR-1262986 | 4.45E+06 | 6.80E−06 | 1.53E−12 | 4.14E+06 | 4.40E−06 | 1.06E−12 |
| IL17-h10F7M11 hIgG1/K mut | PR-1263009 | 4.53E+06 | 7.24E−06 | 1.59E−12 | 4.50E+06 | 3.88E−06 | 8.60E−13 |
| IL17-h10F7M-A6 hIgG1/K mut | PR-1267640 | 2.99E+06 | 4.48E−06 | 1.50E−12 | | | |

TABLE 15-continued

| Antibody | Moniker # | Human IL-17AA | | | Cyno IL-17AA | | |
|---|---|---|---|---|---|---|---|
| | | $k_a$ | $k_d$ | $K_D$ | $k_a$ | $k_d$ | $K_D$ |
| IL17-h10F7M-A11 hIgG1/K mut | PR-1267637 | 3.64E+06 | 7.68E−06 | 2.10E−12 | | | |
| IL17-h10F7M-A16 hIgG1/K mut | PR-1267643 | 2.99E+06 | 4.52E−06 | 1.51E−12 | | | |
| IL17-h10F7M-B13 hIgG1/K mut | PR-1267636 | 2.68E+06 | 6.88E−06 | 2.56E−12 | | | |
| IL17-h10F7M-B20 hIgG1/K mut | PR-1267635 | 2.92E+06 | 6.27E−06 | 2.14E−12 | | | |

Assay for IL-17A and IL-17A/F Induced IL-6 Secretion in Primary Human Foreskin Fibroblasts HS27

The human HS27 cell line (ATCC Accession # CRL-1634) secretes IL-6 in response to IL-17. The IL-17-induced IL-6 secretion is inhibited by neutralizing anti-IL-17 antibodies (See, e.g., *J. Immunol.*, 155: 5483-5486 (1995); *Cytokine*, 9: 794-800 (1997)).

HS27 cells were maintained in assay medium: DMEM high glucose medium (Gibco #11965) with 10% fetal bovine serum (Gibco#26140), 4 mM L-glutamine, 1 mM sodium pyruvate, penicillin G (100 U/500 ml) and streptomycin (100 µg/500 ml). Cells were grown in T150 flasks until they were about 80-90% confluent the day of the assay. Human IL-17A (R&D Systems, #317-IL/CF), or cynomolgous monkey (cyno) IL-17A (generated at Abbott) was reconstituted in sterile PBS without $Ca^{2+}$ and $Mg^{2+}$ stored frozen, freshly thawed for use and diluted to 240 pM (4×) or 4 nM (4×) for IL-17A/F in assay medium. Serial dilutions of antibodies were made in a separate plate (4× concentrations), mixed with equal volume of 240 pM (4×) of huIL-17 or cynoIL-17A or 4 nM (4×) huIL-17A/F and incubated at 37° C. for 1 hour. HS27 cells (typically about 20,000 cells in 50 µl assay medium) were added to each well of a 96-well flat-bottom tissue culture plate (Costar #3599), followed by addition of 50 µl of the pre-incubated antibody plus IL-17 mix. The final concentration of human and cynoIL-17A was 60 µM. The final concentration of human IL-17A/F was 1 nM. Cells were incubated for about 24 hrs at 37° C. The media supernatants were then collected. The level of IL-17 neutralization was measured by determination of IL-6 amounts in supernatant using a commercial Meso Scale Discovery kit (cat# L411AKB-1) according to manufacturer's instruction. IC50 values were obtained using logarithm of antibody versus IL-6 amount variable slope fit.

Assay for IL-17 and TNF-α Induced IL-6 Secretion from Murine Embryonic Fibroblast Cell Line (NIH3T3)

The murine NIH3T3 cell line (ATCC Accession # CRL-1658) secretes IL-6 in response to murine, rat, or rabbit IL-17A and murine TNFα (R&D Systems, Cat#410-MT). The IL-17 induced IL-6 secretion is inhibited by neutralizing anti-IL-17 antibodies.

NIH3T3 cells were maintained in assay medium: DMEM (Invitrogen Cat#11965-092) with 10% fetal bovine serum (Gibco#26140-079), 1% Non Essential Amino Acids, 2 mM L-glutamine, 1 mM sodium pyruvate, penicillin G (100 U/500 ml), and streptomycin (100 µg/500 ml). Cells were grown in T150 flasks until they were about 80-90% confluent the day of the assay. Rat IL17A (Prospec bio, Cat# CYT-542) was reconstituted in sterile PBS, without Ca2+ and Mg2+, with 0.1% BSA, aliquoted and stored frozen at 100 µg/mL. Rabbit IL17A (Abbott, A-1239293.0) was aliquoted and stored frozen at 260 µg/mL. Murine TNF-α was reconstituted in 0.1% BSA/PBS without $Ca^{2+}$ and $Mg^{2+}$ at a concentration of 10 µg/mL, aliquoted, and stored frozen. Freshly thawed IL-17 antibodies were diluted to 200 µg/ml (4×) in assay medium. Serial dilutions of antibodies were made in a separate plate (4× concentrations), mixed with equal volume of 40 ng/ml (4×) murine or rat IL-17A or 100 ng/mL rabbit IL-17A, and incubated at 37° C. for 1 hr.

NIH3T3 cells (typically about 400,000 cells in 50 µl assay medium) were added to each well of a 96-well flat-bottom tissue culture plate (Costar #3599), followed by addition of 50 µl of the pre-incubated antibody plus IL-17 mix. Mu TNF-α at 5.5 ng/mL (10×) was added in 11 µl of media to each well. The final concentration of IL-17A was 10 ng/ml for murine and rat and 25 ng/mL for rabbit. The final concentration for mu TNFα was 0.55 ng/mL. Cells were incubated for about 24 hrs at 37° C. The media supernatants were then collected. The level of IL-17 neutralization was measured by determination of IL-6 amounts in supernatant using a commercial Meso Scale Discovery kit (cat# K112AKA-4) according to manufacturer's instruction. IC50 values were obtained using logarithm of antibody versus IL-6 amount variable slope fit.

TABLE 16

| Antibody | Human 60 pM | Cyno 60 pM | Mouse 3 nM | Rat .3 nM | Rabbit .75 nM |
|---|---|---|---|---|---|
| IL17-h10F7M11 hIgG1/K mut | 40 | 16 | 8 | 83 | 73 |
| IL17-h10F7M10 hIgG1/K mut | 30 | 12 | 8 | 99 | 81 |
| IL17-h10F7M-A6 hIgG1/K mut | 80 | 29 | 130 | 75 | 121 |
| IL17-h10F7M-A11 hIgG1/K mut | 40 | 18 | 31 | 128 | 123 |
| IL17-h10F7M-A16 hIgG1/K mut | 70 | 11 | 23 | 102 | 117 |
| IL17-h10F7M-B13 hIgG1/K mut | 60 | 9 | 60 | 73 | 113 |
| IL17-h10F7M-B20 hIgG1/K mut | 70 | 27 | 39 | 93 | 124 |

Example 3

Generation of Novel of Fully Novel Anti-TNF/IL-17 DVD-Ig Molecules 1.1: Construction of TNF/IL-17 DVD-Ig DNA Constructs Anti-TNF antibody variable domains were combined with multiple IL-17 antibody variable domains by overlapping PCR amplification with intervening linker DNA sequences. The amplified PCR products are subcloned into expression vectors suitable for transient expression in HEK293 cells and the open reading frame regions are confirmed by sequencing before DVD-Ig expression.

Expression and Production of TNF/IL17 DVD-Ig Binding Proteins

After DNA confirmation by sequencing, all DVD-Ig DNA constructs were expanded in *E. coli* and DNA is purified using Qiagen Hispeed Maxi Prep (CAT#12662, QIAGEN). DVD-Ig DNA was transfected into log phase 293E cells (0.5×10⁶/ml, viability >95%) by mixing PEI and DNA @ 2:1 ratio with 0.2 µg/ml heavy chain DNA and 0.3 µg/ml light chain DNA. DNA:PEI complex was formed at room temperature in TC hood for fifteen minutes before adding to 293E cells. Twenty four later, 0.5% TN1 was added to 293E cells. At day five, supernatant was collected for human IgG1 titer measurement. Cell supernatant was harvested at day seven and filtered through 0.2 µM PES filter. Supernatant was purified by using Protein A Sepharose Affinity Chromatography according to manufacturer's instruction. Purified DVD-Igs were eluted off the column by 0.1 M glycine (pH 2.99) and dialyzed into 15 mM histidine buffer (pH 6.0) immediately. The binding proteins were quantitated by A280 and analyzed by mass spectrometry and SEC.

Sequences of TNF/IL-17 DVD-Ig Constructs

Amino acid sequence of heavy chain and light chain of DVD-Ig proteins capable of binding human TNF and hIL-17 were determined. The amino acid sequences of variable heavy chains, variable light chains, and constant regions of TNF/IL-17 DVD-Ig binding proteins are shown in the table below (Table 17). Both wildtype human IgG1 and mutant IgG1 with leu to ala mutations at lower hinge region positions 234, 235 (EU numbering system) have been tested and shown to be comparably active in binding to TNF and IL-17.

TABLE 17

Sequences of variable and constant regions of TNF/IL-17 DVD-Ig binding proteins.

| Protein region | Sequence Identifier | 12345678901234567890 |
|---|---|---|
| DVD HEAVY VARIABLE hMAK195-21-GS10-M11 DVD | SEQ ID NO.: 540 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS<u>GGG</u> <u>GSGGGGS</u>EVQLVQSGAEVKK PGSSVKVSCKASGYTFTDYE IHWVRQAPGQGLEWMGVNDP ESGGTFYNQKFDGRVTLTAD ESTSTAYMELSSLRSEDTAV YYCTRYSKWDSFDGMDYWGQ GTTVTVSS |
| hMAK195-21Vh | SEQ ID NO.: 541 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS |
| LINKER | SEQ ID NO.: 542 | GGGGSGGGGS |
| H10F7-M11Vh | SEQ ID NO.: 543 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVSS |
| CH CG1234, 235 MUT Z NONA | SEQ ID NO.: 544 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |

TABLE 17-continued

Sequences of variable and constant regions of TNF/IL-17 DVD-Ig binding proteins.

| Protein region | Sequence Identifier | 12345678901234567890 |
|---|---|---|
| DVD LIGHT VARIABLE hMAK195-21-GS10-M11 DVD | SEQ ID NO.: 545 | DIQMTQSPSSLSASVGDRVT ITCRASQLVSSAVAWYQQKP GKAPKLLIYWASARHTGVPS RFSGSGSGTDFTLTISSLQP EDFATYYCQQHYKTPFTFGQ GTKLEIKRGGSGGGGSGDIQ MTQSPSSLSASVGDRVTITC RASSGIISYIDWFQQKPGKA PKRLIYATFDLASGVPSRFS GSGSGTDYTLTISSLQPEDF ATYYCRQVGSYPETFGQGTK LEIKR |
| hMAK195-21VL | SEQ ID NO.: 546 | DIQMTQSPSSLSASVGDRVT ITCRASQLVSSAVAWYQQKP GKAPKLLIYWASARHTGVPS RFSGSGSGTDFTLTISSLQP EDFATYYCQQHYKTPFTFGQ GTKLEIKR |
| LINKER | SEQ ID NO.: 547 | GGSGGGGSG |
| H10F7-M11VL | SEQ ID NO.: 548 | DIQMTQSPSSLSASVGDRVT ITCRASSGIISYIDWFQQKP GKAPKRLIYATFDLASGVPS RFSGSGSGTDYTLTISSLQP EDFATYYCRQVGSYPETFGQ GTKLEIKR |
| CL | SEQ ID NO.: 549 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE hMAK195-24-GS10-M11 DVD | SEQ ID NO.: 550 | EVQLVESGGGLVQPGGSLRL SCAASGFTFSNYGVEWVRQA PGKGLEWVSGIWADGSTHYA DTVKSRFTISRDNSKNTLYL QMNSLRAEDTAVYYCAREWQ HGPVAYWGQGTLVTVSSGGG GSGGGGSEVQLVQSGAEVKK PGSSVKVSCKASGYTFTDYE IHWVRQAPGQGLEWMGVNDP ESGGTFYNQKFDGRVTLTAD ESTSTAYMELSSLRSEDTAV YYCTRYSKWDSFDGMDYWGQ GTTVTVSS |
| hMAK195-24Vh | SEQ ID NO.: 551 | EVQLVESGGGLVQPGGSLRL SCAASGFTFSNYGVEWVRQA PGKGLEWVSGIWADGSTHYA DTVKSRFTISRDNSKNTLYL QMNSLRAEDTAVYYCAREWQ HGPVAYWGQGTLVTVSS |
| LINKER | SEQ ID NO.: 552 | GGGGSGGGGS |
| H10F7-M11Vh | SEQ ID NO.: 553 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVSS |
| CH CG1 234, 235 MUT Z NONA | SEQ ID NO.: 554 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN |

TABLE 17-continued

Sequences of variable and constant regions of TNF/IL-17 DVD-Ig binding proteins.

| Protein region | Sequence Identifier | 12345678901234567890 |
|---|---|---|
| | | STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE hMAK195-24-GS10-M11 DVD | SEQ ID NO.: 555 | DIQMTQSPSSLSASVGDRVT ITCKASQLVSSAVAWYQQKP GKAPKLLIYWASTLHTGVPS RFSGSGSGTDFTLTISSLQP EDFATYYCQQHYRTPFTFGQ GTKLEIKR<u>GGSGGGGSG</u>DIQ MTQSPSSLSASVGDRVTITC RASSGIISYIDWFQQKPGKA PKRLIYATFDLASGVPSRFS GSGSGTDYTLTISSLQPEDF ATYYCRQVGSYPETFGQGTK LEIKR |
| hMAK195-24VL | SEQ ID NO.: 556 | DIQMTQSPSSLSASVGDRVT ITCKASQLVSSAVAWYQQKP GKAPKLLIYWASTLHTGVPS RFSGSGSGTDFTLTISSLQP EDFATYYCQQHYRTPFTFGQ GTKLEIKR |
| LINKER | SEQ ID NO.: 557 | GGSGGGGSG |
| H10F7-M11VL | SEQ ID NO.: 558 | DIQMTQSPSSLSASVGDRVT ITCRASSGIISYIDWFQQKP GKAPKRLIYATFDLASGVPS RFSGSGSGTDYTLTISSLQP EDFATYYCRQVGSYPETFGQ GTKLEIKR |
| CL | SEQ ID NO.: 559 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE hMAK195-21-GS10-M10 DVD | SEQ ID NO.: 560 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS<u>GGG GSGGGGS</u>EVQLVQSGAEVKK PGSSVKVSCKASGYTFDDYE IHWVRQAPGQGLEWIGVNDP ESGGTFYNQKFDGRATLTAD KSTSTAYMELSSLRSEDTAV YYCTRYDKWDSFYGMDYWGQ GTTVTVSS |
| hMAK195-21Vh | SEQ ID NO.: 561 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS |
| LINKER | SEQ ID NO.: 562 | GGGGSGGGGS |
| H10F7-M10Vh | SEQ ID NO.: 563 | EVQLVQSGAEVKKPGSSVKV SCKASGYTFDDYEIHWVRQA PGQGLEWIGVNDPESGGTFY NQKFDGRATLTADKSTSTAY MELSSLRSEDTAVYYCTRYD KWDSFYGMDYWGQGTTVTVSS |

TABLE 17-continued

Sequences of variable and constant regions of TNF/IL-17 DVD-Ig binding proteins.

| Protein region | Sequence Identifier | 12345678901234567890 |
|---|---|---|
| CH CG1, 234, 235 MUT Z NONA | SEQ ID NO.: 564 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE hMAK195-21-GS10-M10 DVD | SEQ ID NO.: 565 | DIQMTQSPSSLSASVGDRVT ITCRASQLVSSAVAWYQQKP GKAPKLLIYWASARHTGVPS RFSGSGSGTDFTLTISSLQP EDFATYYCQQHYKTPFTFGQ GTKLEIKRGGSGGGGSGDIQ MTQSPSSLSASVGDRVTITC SASSGSISYIDWFQQKPGKA PKRLIYATFELASGVPSRFS GSGSGTDFTLTISSLQPEDF ATYYCHQLGSYPDTFGQGTK LEIKR |
| hMAK195-21VL | SEQ ID NO.: 566 | DIQMTQSPSSLSASVGDRVT ITCRASQLVSSAVAWYQQKP GKAPKLLIYWASARHTGVPS RFSGSGSGTDFTLTISSLQP EDFATYYCQQHYKTPFTFGQ GTKLEIKR |
| LINKER | SEQ ID NO.: 567 | GGSGGGGSG |
| H10F7-M10VL | SEQ ID NO.: 568 | DIQMTQSPSSLSASVGDRVT ITCSASSGSISYIDWFQQKP GKAPKRLIYATFELASGVPS RFSGSGSGTDFTLTISSLQP EDFATYYCHQLGSYPDTFGQ GTKLEIKR |
| CL | SEQ ID NO.: 569 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE hMAK195-24-GS10-M10 DVD | SEQ ID NO.: 570 | EVQLVESGGGLVQPGGSLRL SCAASGFTFSNYGVEWVRQA PGKGLEWVSGIWADGSTHYA DTVKSRFTISRDNSKNTLYL QMNSLRAEDTAVYYCAREWQ HGPVAYWGQGTLVTVSS<u>GGG GSGGGGS</u>EVQLVQSGAEVKK PGSSVKVSCKASGYTFDDYE IHWVRQAPGQGLEWIGVNDP ESGGTFYNQKFDGRATLTAD KSTSTAYMELSSLRSEDTAV YYCTRYDKWDSFYGMDYWGQ GTTVTVSS |
| hMAK195-24Vh | SEQ ID NO.: 571 | EVQLVESGGGLVQPGGSLRL SCAASGFTFSNYGVEWVRQA PGKGLEWVSGIWADGSTHYA DTVKSRFTISRDNSKNTLYL QMNSLRAEDTAVYYCAREWQ HGPVAYWGQGTLVTVSS |

TABLE 17-continued

Sequences of variable and constant regions of TNF/IL-17 DVD-Ig binding proteins.

| Protein region | Sequence Identifier | 12345678901234567890 |
|---|---|---|
| LINKER | SEQ ID NO.: 572 | GGGGSGGGGS |
| H10F7-M10Vh | SEQ ID NO.: 573 | EVQLVQSGAEVKKPGSSVKV SCKASGYTFDDYEIHWVRQA PGQGLEWIGVNDPESGGTFY NQKFDGRATLTADKSTSTAY MELSSLRSEDTAVYYCTRYD KWDSFYGMDYWGQGTTVTSS |
| CH, CG1234, 235 MUT Z NONA | SEQ ID NO.: 574 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE hMAK195-24-GS10-M10 DVD | SEQ ID NO.: 575 | DIQMTQSPSSLSASVGDRVT ITCKASQLVSSAVAWYQQKP GKAPKLLIYWASTLHTGVPS RFSGSGSGTDFTLTISSLQP EDFATYYCQQHYRTPFTFGQ GTKLEIKR*GGSGGGGSG*DIQ MTQSPSSLSASVGDRVTITC SASSGSISYIDWFQQKPGKA PKRLIYATFELASGVPSRFS GSGSGTDFTLTISSLQPEDF ATYYCHQLGSYPDTFGQGTK LEIKR |
| hMAK195-24VL | SEQ ID NO.: 576 | DIQMTQSPSSLSASVGDRVT ITCKASQLVSSAVAWYQQKP GKAPKLLIYWASTLHTGVPS RFSGSGSGTDFTLTISSLQP EDFATYYCQQHYRTPFTFGQ GTKLEIKR |
| LINKER | SEQ ID NO.: 577 | GGSGGGGSG |
| H10F7-M10VL | SEQ ID NO.: 578 | DIQMTQSPSSLSASVGDRVT ITCSASSGSISYIDWFQQKP GKAPKRLIYATFELASGVPS RFSGSGSGTDFTLTISSLQP EDFATYYCHQLGSYPDTFGQ GTKLEIKR |
| CL | SEQ ID NO.: 579 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE hMAK195-21-GS10-A6 DVD | SEQ ID NO.: 580 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS*GGG GSGGGGS*EVQLVQSGAEVKK PGSSVKVSCKASGYTFTDYE IHWVRQAPGQGLEWIGVNDP DSGGTLYNQKFDGRVTLTAD |

TABLE 17-continued

Sequences of variable and constant regions of TNF/IL-17 DVD-Ig binding proteins.

| Protein region | Sequence Identifier | 12345678901234567890 |
|---|---|---|
| | | ESTSTAYMELSSLRSEDTAVYYCTRYDKWYSFEGMDIWGQGTTVTSS |
| hMAK195-21Vh | SEQ ID NO.: 581 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| LINKER | SEQ ID NO.: 582 | GGGGSGGGGS |
| H10F7-A6 Vh | SEQ ID NO.: 583 | EVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYDKWYSFEGMDIWGQGTTVTVSS |
| CH CG1 234, 235 MUT Z NONA | SEQ ID NO.: 584 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| DVD LIGHT VARIABLE hMAK195-21-GS10-A6 DVD | SEQ ID NO.: 585 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRGGSGGGGSGDIQMTQSPSSLSASVGDRVTITCSASQGIRSYIDWFQQKPGKSPKRLIYATFDLASGVPSRFSGSGSGTDYTLTISSLQPEDFATYYCRQVGNYPGTFGQGTKLEIKR |
| hMAK195-21VL | SEQ ID NO.: 586 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR |
| LINKER | SEQ ID NO.: 587 | GGSGGGGSG |
| H10F7-A6 VL | SEQ ID NO.: 588 | DIQMTQSPSSLSASVGDRVTITCSASQGIRSYIDWFQQKPGKSPKRLIYATFDLASGVPSRFSGSGSGTDYTLTISSLQPEDFATYYCRQVGNYPGTFGQGTKLEIKR |
| CL | SEQ ID NO.: 589 | TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |

TABLE 17-continued

Sequences of variable and constant regions of TNF/IL-17 DVD-Ig binding proteins.

| Protein region | Sequence Identifier | 12345678901234567890 |
| --- | --- | --- |
| DVD HEAVY VARIABLE hMAK195-24-GS10-A6 DVD | SEQ ID NO.: 590 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS<u>GGGGSGGGGS</u>EVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYDKWYSFEGMDIWGQGTTVTVSS |
| hMAK195-24Vh | SEQ ID NO.: 591 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS |
| LINKER | SEQ ID NO.: 592 | GGGGSGGGGS |
| H10F7-A6Vh | SEQ ID NO.: 593 | EVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYDKWYSFEGMDIWGQGTTVTVSS |
| CH CG1 234, 235 MUT Z NONA | SEQ ID NO.: 594 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| DVD LIGHT VARIABLE hMAK195-24-GS10-A6 DVD | SEQ ID NO.: 595 | DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRGGSGGGGSGDIQMTQSPSSLSASVGDRVTITCSASQGIRSYIDWFQQKPGKSPKRLIYATFDLASGVPSRFSGSGSGTDYTLTISSLQPEDFATYYCRQVGNYPGTFGQGTKLEIKR |
| hMAK195-24VL | SEQ ID NO.: 596 | DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKR |
| LINKER | SEQ ID NO.: 597 | GGSGGGGSG |

TABLE 17-continued

Sequences of variable and constant regions of TNF/IL-17 DVD-Ig binding proteins.

| Protein region | Sequence Identifier | 12345678901234567890 |
|---|---|---|
| H10F7-A6 VL | SEQ ID NO.: 598 | DIQMTQSPSSLSASVGDRVT ITCSASQGIRSYIDWFQQKP GKSPKRLIYATFDLASGVPS RFSGSGSGTDYTLTISSLQP EDFATYYCRQVGNYPGTFGQ GTKLEIKR |
| CL | SEQ ID NO.: 599 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE hMAK195-21-GS10-A16 DVD | SEQ ID NO.: 600 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS<u>GGG GSGGGGS</u>EVQLVQSGAEVKK PGSSVKVSCKASGYTFSDYE IHWVRQAPGQGLEWMGVNDP ESGGTFYNQKFDGRVTLTAD ESTSTAYMELSSLRSEDTAV YYCTRYDKWYSFEGMDIWGQ GTTVTVSS |
| hMAK195-21Vh | SEQ ID NO.: 601 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS |
| LINKER | SEQ ID NO.: 602 | GGGGSGGGGS |
| H10F7-A16Vh | SEQ ID NO.: 603 | EVQLVQSGAEVKKPGSSVKV SCKASGYTFSDYEIHWVRQA PGQGLEWMGVNDPESGGTFY NQKFDGRVTLTADESTSTAY MELSSLRSEDTAVYYCTRYD KWYSFEGMDIWGQGTTVTVS S |
| CH CG1, 234, 235 MUT Z NONA | SEQ ID NO.: 604 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD HEAVY VARIABLE hMAK195-24-GS10-A16 DVD | SEQ ID NO.: 605 | EVQLVESGGGLVQPGGSLRL SCAASGFTFSNYGVEWVRQA PGKGLEWVSGIWADGSTHYA DTVKSRFTISRDNSKNTLYL QMNSLRAEDTAVYYCAREWQ HGPVAYWGQGTLVTVSS<u>GGG GSGGGGS</u>EVQLVQSGAEVKK PGSSVKVSCKASGYTFSDYE IHWVRQAPGQGLEWMGVNDP ESGGTFYNQKFDGRVTLTAD |

TABLE 17-continued

Sequences of variable and constant regions of TNF/IL-17 DVD-Ig binding proteins.

| Protein region | Sequence Identifier | 12345678901234567890 |
| --- | --- | --- |
| | | ESTSTAYMELSSLRSEDTAV YYCTRYDKWYSFEGMDIWGQ GTTVTVSS |
| hMAK195-24Vh | SEQ ID NO.: 606 | EVQLVESGGGLVQPGGSLRL SCAASGFTFSNYGVEWVRQA PGKGLEWVSGIWADGSTHYA DTVKSRFTISRDNSKNTLYL QMNSLRAEDTAVYYCAREWQ HGPVAYWGQGTLVTVSS |
| LINKER | SEQ ID NO.: 607 | GGGGSGGGGS |
| H10F7-A16Vh | SEQ ID NO.: 608 | EVQLVQSGAEVKKPGSSVKV SCKASGYTFSDYEIHWVRQA PGQGLEWMGVNDPESGGTFY NQKFDGRVTLTADESTSTAY MELSSLRSEDTAVYYCTRYD KWYSFEGMDIWGQGTTVTVS S |
| CH CG1, 234, 235 MUT Z NONA | SEQ ID NO.: 609 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD HEAVY VARIABLE hMAK195-21-GS10-A11 DVD | SEQ ID NO.: 610 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS<u>GGG GSGGGGS</u>EVQLVQSGAEVKK PGSSVKVSCKASGYTFTDYE IHWVRQAPGQGLEWIGVNDP ESGGTFYNQKFDGRVTLSAD ESTSTAYMELSSLRSEDTAV YYCTRYDKYWSFEGMDYWGQ GTTVTVSS |
| hMAK195-21Vh | SEQ ID NO.: 611 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS |
| LINKER | SEQ ID NO.: 612 | GGGGSGGGGS |
| H10F7-A11Vh | SEQ ID NO.: 613 | EVQLVQSGAEVKKPGSSVKV SCKASGYTFTDYEIHWVRQA PGQGLEWIGVNDPESGGTFY NQKFDGRVTLSADESTSTAY MELSSLRSEDTAVYYCTRYD KYWSFEGMDYWGQGTTVTVS S |
| CH CG1234, 235 MUT Z NONA | SEQ ID NO.: 614 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP |

TABLE 17-continued

Sequences of variable and constant regions of TNF/IL-17 DVD-Ig binding proteins.

| Protein region | Sequence Identifier | 12345678901234567890 |
|---|---|---|
| | | KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD HEAVY VARIABLE hMAK195-24-GS10-A11 DVD | SEQ ID NO.: 615 | EVQLVESGGGLVQPGGSLRL SCAASGFTFSNYGVTWVRQA PGKGLEWVSGIWADGSTHYA DTVKSRFTISRDNSKNTLYL QMNSLRAEDTAVYYCAREWQ HGPVAYWGQGTLVTVSS<u>GGG GSGGGGS</u>EVQLVQSGAEVKK PGSSVKVSCKASGYTFTDYE IHWVRQAPGQGLEWIGVNDP ESGGTFYNQKFDGRVTLSAD ESTSTAYMELSSLRSEDTAV YYCTRYDKYWSFEGMDYWGQ GTTVTVSS |
| hMAK195-21Vh | SEQ ID NO.: 616 | EVQLVESGGGLVQPGGSLRL SCAASGFTFSNYGVEWVRQA PGKGLEWVSGIWADGSTHYA DTVKSRFTISRDNSKNTLYL QMNSLRAEDTAVYYCAREWQ HGPVAYWGQGTLVTVSS |
| LINKER | SEQ ID NO.: 617 | GGGGSGGGGS |
| H10F7-A11Vh | SEQ ID NO.: 618 | EVQLVQSGAEVKKPGSSVKV SCKASGYTFTDYEIHWVRQA PGQGLEWIGVNDPESGGTFY NQKFDGRVTLSADESTSTAY MELSSLRSEDTAVYYCTRYD KYWSFEGMDYWGQGTTVTVS S |
| CH CG1 234, 235 MUT Z NONA | SEQ ID NO.: 619 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD HEAVY VARIABLE hMAK195-21-GS10-B13 DVD | SEQ ID NO.: 620 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS<u>GGG GSGGGGS</u>EVQLVQSGAEVKK PGSSVKVSCKASGYTFSDYE IHWVRQAPGQGLEWMGVNDP ESGGTFYNQKFDGRVTLTAD ESTSTAYMELSSLRSEDTAV YYCTRYDKYWSFEGMDYWGQ GTTVTVSS |

TABLE 17-continued

Sequences of variable and constant regions of TNF/IL-17 DVD-Ig binding proteins.

| Protein region | Sequence Identifier | 12345678901234567890 |
|---|---|---|
| hMAK195-21Vh | SEQ ID NO.: 621 | EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS |
| LINKER | SEQ ID NO.: 622 | GGGGSGGGGS |
| H10F7-B13Vh | SEQ ID NO.: 623 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKYWSFEGMDYWGQGTTVTVSS |
| CH CG1, 234, 235 MUT Z NONA | SEQ ID NO.: 624 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| DVD HEAVY VARIABLE hMAK195-24-GS10-B13 DVD | SEQ ID NO.: 625 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS<u>GGGGSGGGGS</u>EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKYWSFEGMDYWGQGTTVTVSS |
| hMAK195-24Vh | SEQ ID NO.: 626 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS |
| LINKER | SEQ ID NO.: 627 | GGGGSGGGGS |
| H10F7-B13 Vh | SEQ ID NO.: 628 | EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKYWSFEGMDYWGQGTTVTVSS |
| CH CG1, 234, 235 MUT Z NONA | SEQ ID NO.: 629 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYN |

TABLE 17-continued

Sequences of variable and constant regions of TNF/IL-17 DVD-Ig binding proteins.

| Protein region | Sequence Identifier | 12345678901234567890 |
|---|---|---|
| | | STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD HEAVY VARIABLE hMAK195-21-GS10-B20 DVD | SEQ ID NO.: 630 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS<u>GGG GSGGGGS</u>EVQLVQSGAEVKK PGSSVKVSCKASGYTFTDYE IHWVRQAPGQGLEWMGVNDP ESGGTFYNQKFDGRVTLTAD ESTSTAYMELSSLRSEDTAV YYCTRYDKWYSFEGMDIWGQ GTTVTVSS |
| hMAK195-21Vh | SEQ ID NO.: 631 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS |
| LINKER | SEQ ID NO.: 632 | GGGGSGGGGS |
| H10F7-B20Vh | SEQ ID NO.: 633 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYD KWYSFEGMDIWGQGTTVTVS S |
| CH CG1234, 235 MUT Z NONA | SEQ ID NO.: 634 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD HEAVY VARIABLE hMAK195-24-GS10-B20 DVD | SEQ ID NO.: 635 | EVQLVESGGGLVQPGGSLRL SCAASGFTFSNYGVEWVRQA PGKGLEWVSGIWADGSTHYA DTVKSRFTISRDNSKNTLYL QMNSLRAEDTAVYYCAREWQ HGPVAYWGQGTLVTVSS<u>GGG GSGGGGS</u>EVQLVQSGAEVKK PGSSVKVSCKASGYTFTDYE IHWVRQAPGQGLEWMGVNDP ESGGTFYNQKFDGRVTLTAD ESTSTAYMELSSLRSEDTAV YYCTRYDKWYSFEGMDIWGQ GTTVTVSS |
| hMAK195-24Vh | SEQ ID NO.: 636 | EVQLVESGGGLVQPGGSLRL SCAASGFTFSNYGVEWVRQA PGKGLEWVSGIWADGSTHYA |

TABLE 17-continued

Sequences of variable and constant regions of TNF/IL-17 DVD-Ig binding proteins.

| Protein region | Sequence Identifier | 12345678901234567890 |
|---|---|---|
| | | DTVKSRFTISRDNSKNTLYL QMNSLRAEDTAVYYCAREWQ HGPVAYWGQGTLVTVSS |
| LINKER | SEQ ID NO.: 637 | GGGGSGGGGS |
| H10F7-B20Vh | SEQ ID NO.: 638 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYD KWYSFEGMDIWGQGTTVTVS S |
| CH CG1 234, 235 MUT Z NONA | SEQ ID NO.: 639 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD HEAVY VARIABLE H10F7-M10-GS10-HMAK195-21 DVD | SEQ ID NO.: 640 | EVQLVQSGAEVKKPGSSVKV SCKASGYTFDDYEIHWVRQA PGQGLEWIGVNDPESGGTFY NQKFDGRATLTADKSTSTAY MELSSLRSEDTAVYYCTRYD KWDSFYGMDYWGQGTTVTVS SGGGGSGGGGSEVQLVESGG GLVQPGGSLRLSCAASGFTF SNYGVTWVRQAPGKGLEWVS MIWADGSTHYASSVKGRFTI SRDNSKNTLYLQMNSLRAED TAVYYCAREWQHGPVAYWGQ GTLVTVSS |
| H10F7-M10Vh | SEQ ID NO.: 641 | EVQLVQSGAEVKKPGSSVKV SCKASGYTFDDYEIHWVRQA PGQGLEWIGVNDPESGGTFY NQKFDGRATLTADKSTSTAY MELSSLRSEDTAVYYCTRYD KWDSFYGMDYWGQGTTVTVS S |
| LINKER | SEQ ID NO.: 642 | GGGGSGGGGS |
| HMAK195-21 Vh | SEQ ID NO.: 643 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS |
| CH CG1, 234, 235 MUT Z NONA | SEQ ID NO.: 644 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE |

TABLE 17-continued

Sequences of variable and constant regions of TNF/IL-17 DVD-Ig binding proteins.

| Protein region | Sequence Identifier | 12345678901234567890 |
| --- | --- | --- |
| | | MTKNQVSLTCLVKGFYPSDIAVEWESNGQPENNYKTTPPVLDSDGSFFLYSKLTVDKSRWQQGNVFSCSVMHEALHNHYTQKSLSLSPGK |
| DVD LIGHT VARIABLE h10F7-M10-GS10-hMAK195-21 DVD | SEQ ID NO.: 645 | DIQMTQSPSSLSASVGDRVTITCSASSGSISYIDWFQQKPGKAPKRLIYATFELASGVPSRFSGSGSGTDFTLTISSLQPEDFATYYCHQLGSYPDTFGQGTKLEIKRGGSGGGGSGDIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR |
| H10F7-M10VL | SEQ ID NO.: 646 | DIQMTQSPSSLSASVGDRVTITCSASSGSISYIDWFQQKPGKAPKRLIYATFELASGVPSRFSGSGSGTDFTLTISSLQPEDFATYYCHQLGSYPDTFGQGTKLEIKR |
| LINKER | SEQ ID NO.: 647 | GGSGGGGSG |
| HMAK195-21VL | SEQ ID NO.: 648 | DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR |
| CL | SEQ ID NO.: 649 | TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| DVD HEAVY VARIABLE H10F7-M10-GS10-HMAK195-24 DVD | SEQ ID NO.: 650 | EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWDSFYGMDYWGQGTTVTVSSGGGGSGGGGSEVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS |
| H10F7-M10Vh | SEQ ID NO.: 651 | EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWDSFYGMDYWGQGTTVTVSS |
| LINKER | SEQ ID NO.: 652 | GGGGSGGGGS |
| HMAK195-24 Vh | SEQ ID NO.: 653 | EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS |

TABLE 17-continued

Sequences of variable and constant regions of TNF/IL-17 DVD-Ig binding proteins.

| Protein region | Sequence Identifier | 12345678901234567890 |
|---|---|---|
| CH CG1. 234, 235 MUT Z NONA | SEQ ID NO.: 654 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE h10F7-M10-GS10- hMAK195-24 DVD | SEQ ID NO.: 655 | DIQMTQSPSSLSASVGDRVT ITCSASSGSISYIDWFQQKP GKAPKRLIYATFELASGVPS RFSGSGSGTDFTLTISSLQP EDFATYYCHQLGSYPDTFGQ GTKLEIKRGGSGGGGSGDIQ MTQSPSSLSASVGDRVTITC KASQLVSSAVAWYQQKPGKA PKLLIYWASTLHTGVPSRFS GSGSGTDFTLTISSLQPEDF ATYYCQQHYRTPFTFGQGTK LEIKR |
| H10F7-M10VL | SEQ ID NO.: 656 | DIQMTQSPSSLSASVGDRVT ITCSASSGSISYIDWFQQKP GKAPKRLIYATFELASGVPS RFSGSGSGTDFTLTISSLQP EDFATYYCHQLGSYPDTFGQ GTKLEIKR |
| LINKER | SEQ ID NO.: 657 | GGSGGGGSG |
| HMAK195-24VL | SEQ ID NO.: 658 | DIQMTQSPSSLSASVGDRVT ITCKASQLVSSAVAWYQQKP GKAPKLLIYWASTLHTGVPS RFSGSGSGTDFTLTISSLQP EDFATYYCQQHYRTPFTFGQ GTKLEIKR |
| CL | SEQ ID NO.: 659 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE HMAK199-1-GS10- H10F7-M11 DVD | SEQ ID NO.: 660 | EVQLVQSGAEVKKPGASVKV SCKASGYTFANYGIIWVRQA PGQGLEWMGWINTYTGKPTY AQKFQGRVTMTTDTSTSTAY MELSSLRSEDTAVYYCARKL FTTMDVTDNAMDYWGQGTTV TVSSGGGGSGGGGSEVQLVQ SGAEVKKPGSSVKVSCKASG YTFTDYEIHWVRQAPGQGLE WMGVNDPESGGTFYNQKFDG RVTLTADESTSTAYMELSSL RSEDTAVYYCTRYSKWDSFD GMDYWGQGTTVTVSS |
| HMAK199-1Vh | SEQ ID NO.: 661 | EVQLVQSGAEVKKPGASVKV SCKASGYTFANYGIIWVRQA PGQGLEWMGWINTYTGKPTY AQKFQGRVTMTTDTSTSTAY MELSSLRSEDTAVYYCARKL FTTMDVTDNAMDYWGQGTTV TVSS |

TABLE 17-continued

Sequences of variable and constant regions of TNF/IL-17 DVD-Ig binding proteins.

| Protein region | Sequence Identifier | 12345678901234567890 |
| --- | --- | --- |
| LINKER | SEQ ID NO.: 662 | GGGGSGGGGS |
| H10F7-M11 Vh | SEQ ID NO.: 663 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS S |
| CH CG1234, 235 MUT Z NONA | SEQ ID NO.: 664 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE HMAK199-1-GS10-H10F7-M11DVD | SEQ ID NO.: 665 | DIQMTQSPSSLSASVGDRVT ITCRASQDISQYLNWYQQKP GKAPKLLIYYTSRLQSGVPS RFSGSGSGTDFTLTISSLQP EDFATYFCQQGNTWPPTFGQ GTKLEIKRGGSGGGGSGDIQ MTQSPSSLSASVGDRVTITC RASSGIISYIDWFQQKPGKA PKRLIYATFDLASGVPSRFS GSGSGTDYTLTISSLQPEDF ATYYCRQVGSYPETFGQGTK LEIKR |
| HMAK199-1 VL | SEQ ID NO.: 666 | DIQMTQSPSSLSASVGDRVT ITCRASQDISQYLNWYQQKP GKAPKLLIYYTSRLQSGVPS RFSGSGSGTDFTLTISSLQP EDFATYFCQQGNTWPPTFGQ GTKLEIKR |
| LINKER | SEQ ID NO.: 667 | GGSGGGGSG |
| H10F7-M11VL | SEQ ID NO.: 668 | DIQMTQSPSSLSASVGDRVT ITCRASSGIISYIDWFQQKP GKAPKRLIYATFDLASGVPS RFSGSGSGTDYTLTISSLQP EDFATYYCRQVGSYPETFGQ GTKLEIKR |
| CL | SEQ ID NO.: 669 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE HMAK199-1-GS10-H10F7-M10 DVD | SEQ ID NO.: 670 | EVQLVQSGAEVKKPGASVKV SCKASGYTFANYGIIWVRQA PGQGLEWMGWINTYTGKPTY AQKFQGRVTMTTDTSTSTAY MELSSLRSEDTAVYYCARKL FTTMDVTDNAMDYWGQGTTV TVSSGGGGSGGGGSEVQLVQ SGAEVKKPGSSVKVSCKASG YTFDDYEIHWVRQAPGQGLE WIGVNDPESGGTFYNQKFDG |

TABLE 17-continued

Sequences of variable and constant regions of TNF/IL-17 DVD-Ig binding proteins.

| Protein region | Sequence Identifier | 12345678901234567890 |
|---|---|---|
| | | RATLTADKSTSTAYMELSSL RSEDTAVYYCTRYDKWDSFY GMDYWGQGTTVTVSS |
| HMAK199-1Vh | SEQ ID NO.: 671 | EVQLVQSGAEVKKPGASVKV SCKASGYTFANYGIIWVRQA PGQGLEWMGWINTYTGKPTY AQKFQGRVTMTTDTSTSTAY MELSSLRSEDTAVYYCARKL FTTMDVTDNAMDYWGQGTTV TVSS |
| LINKER | SEQ ID NO.: 672 | GGGGSGGGGS |
| H10F7-M10 Vh | SEQ ID NO.: 673 | EVQLVQSGAEVKKPGSSVKV SCKASGYTFDDYEIHWVRQA PGQGLEWIGVNDPESGGTFY NQKFDGRATLTADKSTSTAY MELSSLRSEDTAVYYCTRYD KWDSFYGMDYWGQGTTVTVS S |
| CH CG1234, 235 MUT Z NONA | SEQ ID NO.: 674 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE HMAK199-1-GS10- H10F7-M10DVD | SEQ ID NO.: 675 | DIQMTQSPSSLSASVGDRVT ITCRASQDISQYLNWYQQKP GKAPKLLIYYTSRLQSGVPS RFSGSGSGTDFTLTISSLQP EDFATYFCQQGNTWPPTFGQ GTKLEIKRGGSGGGGSGDIQ MTQSPSSLSASVGDRVTITC SASSGSISYIDWFQQKPGKA PKRLIYATFELASGVPSRFS GSGSGTDFTLTISSLQPEDF ATYYCHQLGSYPDTFGQGTK LEIKR |
| HMAK199-1 VL | SEQ ID NO.: 676 | DIQMTQSPSSLSASVGDRVT ITCRASQDISQYLNWYQQKP GKAPKLLIYYTSRLQSGVPS RFSGSGSGTDFTLTISSLQP EDFATYFCQQGNTWPPTFGQ GTKLEIKR |
| LINKER | SEQ ID NO.: 677 | GGSGGGGSG |
| H10F7-M10VL | SEQ ID NO.: 678 | DIQMTQSPSSLSASVGDRVT ITCSASSGSISYIDWFQQKP GKAPKRLIYATFELASGVPS RFSGSGSGTDFTLTISSLQP EDFATYYCHQLGSYPDTFGQ GTKLEIKR |
| CL | SEQ ID NO.: 679 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |

TABLE 17-continued

Sequences of variable and constant regions of TNF/IL-17 DVD-Ig binding proteins.

| Protein region | Sequence Identifier | 12345678901234567890 |
|---|---|---|
| DVD HEAVY VARIABLE HMAK199-10-GS10-H10F7-M11 DVD | SEQ ID NO.: 680 | EVQLVQSGAEVKKPGASVKV SCKASGYTFNNYGIIWVRQA PGQGLEWMGWINTYSGKPTY AQKFQGRVTMTTDTSTSTAY MELSSLRSEDTAVYFCARKL FTTMDVTDNAMDYWGQGTTV TVSSGGGGSGGGGSEVQLVQ SGAEVKKPGSSVKVSCKASG YTFTDYEIHWVRQAPGQGLE WMGVNDPESGGTFYNQKFDG RVTLTADESTSTAYMELSSL RSEDTAVYYCTRYSKWDSFD GMDYWGQGTTVTVSS |
| HMAK199-10Vh | SEQ ID NO.: 681 | EVQLVQSGAEVKKPGASVKV SCKASGYTFNNYGIIWVRQA PGQGLEWMGWINTYSGKPTY AQKFQGRVTMTTDTSTSTAY MELSSLRSEDTAVYFCARKL FTTMDVTDNAMDYWGQGTTV TVSS |
| LINKER | SEQ ID NO.: 682 | GGGGSGGGGS |
| H10F7-M11 Vh | SEQ ID NO.: 683 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS S |
| CH CG1, 234, 235 MUT Z NONA | SEQ ID NO.: 684 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE HMAK199-10-GS10-H10F7-M11DVD | SEQ ID NO.: 685 | DIQMTQSPSSLSASVGDRVT ITCRASQDISNFLNWYQQKP GKAPKLLIYYTSRLQSGVPS RFSGSGSGTDYTLTISSLQP EDFATYFCQQGNTQPPTFGQ GTKLEIKRGGSGGGGSGDIQ MTQSPSSLSASVGDRVTITC RASSGIISYIDWFQQKPGKA PKRLIYATFDLASGVPSRFS GSGSGTDYTLTISSLQPEDF ATYYCRQVGSYPETFGQGTK LEIKR |
| HMAK199-10 VL | SEQ ID NO.: 686 | DIQMTQSPSSLSASVGDRVT ITCRASQDISNFLNWYQQKP GKAPKLLIYYTSRLQSGVPS RFSGSGSGTDYTLTISSLQP EDFATYFCQQGNTQPPTFGQ GTKLEIKR |
| LINKER | SEQ ID NO.: 687 | GGSGGGGSG |
| H10F7-M11VL | SEQ ID NO.: 688 | DIQMTQSPSSLSASVGDRVT ITCRASSGIISYIDWFQQKP GKAPKRLIYATFDLASGVPS |

TABLE 17-continued

Sequences of variable and constant regions of TNF/IL-17 DVD-Ig binding proteins.

| Protein region | Sequence Identifier | 12345678901234567890 |
|---|---|---|
| | | RFSGSGSGTDYTLTISSLQP EDFATYYCRQVGSYPETFGQ GTKLEIKR |
| CL | SEQ ID NO.: 689 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE HMAK199-10-GS10-H10F7-M10 DVD | SEQ ID NO.: 690 | EVQLVQSGAEVKKPGASVKV SCKASGYTFNNYGIIWVRQA PGQGLEWMGWINTYSGKPTY AQKFQGRVTMTTDTSTSTAY MELSSLRSEDTAVYFCARKL FTTMDVTDNAMDYWGQGTTV TVSSGGGGSGGGGSEVQLVQ SGAEVKKPGSSVKVSCKASG YTFDDYEIHWVRQAPGQGLE WIGVNDPESGGTFYNQKFDG RATLTADKSTSTAYMELSSL RSEDTAVYYCTRYDKWDSFY GMDYWGQGTTVTVSS |
| HMAK199-10Vh | SEQ ID NO.: 691 | EVQLVQSGAEVKKPGASVKV SCKASGYTFNNYGIIWVRQA PGQGLEWMGWINTYSGKPTY AQKFQGRVTMTTDTSTSTAY MELSSLRSEDTAVYFCARKL FTTMDVTDNAMDYWGQGTTV TVSS |
| LINKER | SEQ ID NO.: 692 | GGGGSGGGGS |
| H10F7-M10 Vh | SEQ ID NO.: 693 | EVQLVQSGAEVKKPGSSVKV SCKASGYTFDDYEIHWVRQA PGQGLEWIGVNDPESGGTFY NQKFDGRATLTADKSTSTAY MELSSLRSEDTAVYYCTRYD KWDSFYGMDYWGQGTTVTVS S |
| CH CG1, 234, 235 MUT Z NONA | SEQ ID NO.: 694 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE HMAK199-10-GS10-H10F7-M10DVD | SEQ ID NO.: 695 | DIQMTQSPSSLSASVGDRVT ITCRASQDISNFLNWYQQKP GKAPKLLIYYTSRLQSGVPS RFSGSGSGTDYTLTISSLQP EDFATYFCQQGNTQPPTFGQ GTKLEIKRGGSGGGGSGDIQ MTQSPSSLSASVGDRVTITC SASSGSISYIDWFQQKPGKA PKRLIYATFELASGVPSRFS GSGSGTDFTLTISSLQPEDF ATYYCHQLGSYPDTFGQGTK LEIKR |

TABLE 17-continued

Sequences of variable and constant regions of TNF/IL-17 DVD-Ig binding proteins.

| Protein region | Sequence Identifier | 12345678901234567890 |
|---|---|---|
| HMAK199-10 VL | SEQ ID NO.: 696 | DIQMTQSPSSLSASVGDRVT ITCRASQDISNFLNWYQQKP GKAPKLLIYYTSRLQSGVPS RFSGSGSGTDYTLTISSLQP EDFATYFCQQGNTQPPTFGQ GTKLEIKR |
| LINKER | SEQ ID NO.: 697 | GGSGGGGSG |
| H10F7-M10VL | SEQ ID NO.: 698 | DIQMTQSPSSLSASVGDRVT ITCSASSGSISYIDWFQQKP GKAPKRLIYATFELASGVPS RFSGSGSGTDFTLTISSLQP EDFATYYCHQLGSYPDTFGQ GTKLEIKR |
| CL | SEQ ID NO.: 699 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE HMAK199-6-GS10-H10F7-M11 DVD | SEQ ID NO.: 700 | EVQLVQSGAEVKKPGASVKV SCKASGYTFNNYGINWVRQA PGQGLEWMGWINTYTGKPTY AQKFQGRVTMTTDTSTSTAY MELSSLRSEDTAVYFCARKF RNTVAVTDYAMDYWGQGTTV TVSSGGGGSGGGGSEVQLVQ SGAEVKKPGSSVKVSCKASG YTFTDYEIHWVRQAPGQGLE WMGVNDPESGGTFYNQKFDG RVTLTADESTSTAYMELSSL RSEDTAVYYCTRYSKWDSFD GMDYWGQGTTVTVSS |
| HMAK199-6Vh | SEQ ID NO.: 701 | EVQLVQSGAEVKKPGASVKV SCKASGYTFNNYGINWVRQA PGQGLEWMGWINTYTGKPTY AQKFQGRVTMTTDTSTSTAY MELSSLRSEDTAVYFCARKF RNTVAVTDYAMDYWGQGTTV TVSS |
| LINKER | SEQ ID NO.: 702 | GGGGSGGGGS |
| H10F7-M11 Vh | SEQ ID NO.: 703 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS S |
| CH CG1, 234, 235 MUT Z NONA | SEQ ID NO.: 704 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |

TABLE 17-continued

Sequences of variable and constant regions of TNF/IL-17 DVD-Ig binding proteins.

| Protein region | Sequence Identifier | 12345678901234567890 |
|---|---|---|
| DVD LIGHT VARIABLE HMAK199-6-GS10-H10F7-M11DVD | SEQ ID NO.: 705 | DIQMTQSPSSLSASVGDRVT ITCRASQDIYDVLNWYQQKP GKAPKLLIYYASRLQSGVPS RFSGSGSGTDFTLTISSLQP EDFATYYCQQGITLPPTFGQ GTKLEIKRGGSGGGGSGDIQ MTQSPSSLSASVGDRVTITC RASSGIISYIDWFQQKPGKA PKRLIYATFDLASGVPSRFS GSGSGTDYTLTISSLQPEDF ATYYCRQVGSYPETFGQGTK LEIKR |
| HMAK199-6 VL | SEQ ID NO.: 706 | DIQMTQSPSSLSASVGDRVT ITCRASQDIYDVLNWYQQKP GKAPKLLIYYASRLQSGVPS RFSGSGSGTDFTLTISSLQP EDFATYYCQQGITLPPTFGQ GTKLEIKR |
| LINKER | SEQ ID NO.: 707 | GGSGGGGSG |
| H10F7-M11VL | SEQ ID NO.: 708 | DIQMTQSPSSLSASVGDRVT ITCRASSGIISYIDWFQQKP GKAPKRLIYATFDLASGVPS RFSGSGSGTDYTLTISSLQP EDFATYYCRQVGSYPETFGQ GTKLEIKR |
| CL | SEQ ID NO.: 709 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE HMAK199-6-GS10-H10F7-M10 DVD | SEQ ID NO.: 710 | EVQLVQSGAEVKKPGASVKV SCKASGYTFNNYGINWVRQA PGQGLEWMGWINTYTGKPTY AQKFQGRVTMTTDTSTSTAY MELSSLRSEDTAVYFCARKF RNTVAVTDYAMDYWGQGTTV TVSSGGGGSGGGGSEVQLVQ SGAEVKKPGSSVKVSCKASG YTFDDYEIHWVRQAPGQGLE WIGVNDPESGGTFYNQKFDG RATLTADKSTSTAYMELSSL RSEDTAVYYCTRYDKWDSFY GMDYWGQGTTVTVSS |
| HMAK199-6Vh | SEQ ID NO.: 711 | EVQLVQSGAEVKKPGASVKV SCKASGYTFNNYGINWVRQA PGQGLEWMGWINTYTGKPTY AQKFQGRVTMTTDTSTSTAY MELSSLRSEDTAVYFCARKF RNTVAVTDYAMDYWGQGTTV TVSS |
| LINKER | SEQ ID NO.: 712 | GGGGSGGGGS |
| H10F7-M10 Vh | SEQ ID NO.: 713 | EVQLVQSGAEVKKPGSSVKV SCKASGYTFDDYEIHWVRQA PGQGLEWIGVNDPESGGTFY NQKFDGRATLTADKSTSTAY MELSSLRSEDTAVYYCTRYD KWDSFYGMDYWGQGTTVTVS S |
| CH CG1, 234, 235 MUT Z NONA | SEQ ID NO.: 714 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP |

TABLE 17-continued

Sequences of variable and constant regions of TNF/IL-17 DVD-Ig binding proteins.

| Protein region | Sequence Identifier | 12345678901234567890 |
|---|---|---|
| | | EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE HMAK199-6-GS10-H10F7-M10 DVD | SEQ ID NO.: 715 | DIQMTQSPSSLSASVGDRVT ITCRASQDIYDVLNWYQQKP GKAPKLLIYYASRLQSGVPS RFSGSGSGTDFTLTISSLQP EDFATYYCQQGITLPPTFGQ GTKLEIKRGGSGGGGSGDIQ MTQSPSSLSASVGDRVTITC SASSGSISYIDWFQQKPGKA PKRLIYATFELASGVPSRFS GSGSGTDFTLTISSLQPEDF ATYYCHQLGSYPDTFGQGTK LEIKR |
| HMAK199-6 VL | SEQ ID NO.: 716 | DIQMTQSPSSLSASVGDRVT ITCRASQDIYDVLNWYQQKP GKAPKLLIYYASRLQSGVPS RFSGSGSGTDFTLTISSLQP EDFATYYCQQGITLPPTFGQ GTKLEIKR |
| LINKER | SEQ ID NO.: 717 | GGSGGGGSG |
| H10F7-M10VL | SEQ ID NO.: 718 | DIQMTQSPSSLSASVGDRVT ITCSASSGSISYIDWFQQKP GKAPKRLIYATFELASGVPS RFSGSGSGTDFTLTISSLQP EDFATYYCHQLGSYPDTFGQ GTKLEIKR |
| CL | SEQ ID NO.: 719 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE HMAK199-4-GS10-H10F7-M11 DVD | SEQ ID NO.: 720 | EVQLVQSGAEVKKPGASVKV SCKASGYTFNNYGIIWVRQA PGQGLEWMGWINTYTGKPTY AQKFQGRVTMTTDTSTSTAY MELSSLRSEDTAVYYCARKL FNTVAVTDNAMDYWGQGTTV TVSSGGGGSGGGGSEVQLVQ SGAEVKKPGSSVKVSCKASG YTFTDYEIHWVRQAPGQGLE WMGVNDPESGGTFYNQKFDG RVTLTADESTSTAYMELSSL RSEDTAVYYCTRYSKWDSFD GMDYWGQGTTVTVSS |
| HMAK199-4Vh | SEQ ID NO.: 721 | EVQLVQSGAEVKKPGASVKV SCKASGYTFNNYGIIWVRQA PGQGLEWMGWINTYTGKPTY AQKFQGRVTMTTDTSTSTAY MELSSLRSEDTAVYYCARKL FNTVAVTDNAMDYWGQGTTV TVSS |
| LINKER | SEQ ID NO.: 722 | GGGGSGGGGS |
| H10F7-M11Vh | SEQ ID NO.: 723 | EVQLVQSGAEVKKPGSSVKV SCKASGYTFTDYEIHWVRQA PGQGLEWMGVNDPESGGTFY NQKFDGRVTLTADESTSTAY |

TABLE 17-continued

Sequences of variable and constant regions of TNF/IL-17 DVD-Ig binding proteins.

| Protein region | Sequence Identifier | 12345678901234567890 |
|---|---|---|
| | | MELSSLRSEDTAVYYCTRYS KWDSFDGMDYWGQGTTVTVS S |
| CH CG1, 234, 235 MUT Z NONA | SEQ ID NO.: 724 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE HMAK199-4-GS10- H10F7-M11 DVD | SEQ ID NO.: 725 | DIQMTQSPSSLSASVGDRVT ITCRASQDIENYLNWYQQKP GKAPKLLIYYTSRLQSGVPS RFSGSGSGTDFTLTISSLQP EDFATYFCQQGNTQPPTFGQ GTKLEIKRGGSGGGGSGDIQ MTQSPSSLSASVGDRVTITC RASSGIISYIDWFQQKPGKA PKRLIYATFDLASGVPSRFS GSGSGTDYTLTISSLQPEDF ATYYCRQVGSYPETFGQGTK LEIKR |
| HMAK199-4 VL | SEQ ID NO.: 726 | DIQMTQSPSSLSASVGDRVT ITCRASQDIENYLNWYQQKP GKAPKLLIYYTSRLQSGVPS RFSGSGSGTDFTLTISSLQP EDFATYFCQQGNTQPPTFGQ GTKLEIKR |
| LINKER | SEQ ID NO.: 727 | GGSGGGGSG |
| H10F7-M11VL | SEQ ID NO.: 728 | DIQMTQSPSSLSASVGDRVT ITCRASSGIISYIDWFQQKP GKAPKRLIYATFDLASGVPS RFSGSGSGTDYTLTISSLQP EDFATYYCRQVGSYPETFGQ GTKLEIKR |
| CL | SEQ ID NO.: 729 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE HMAK195-24-SS- H10F7-M11 DVD | SEQ ID NO.: 730 | EVQLVESGGGLVQPGGSLRL SCAASGFTFSNYGVEWVRQA PGKGLEWVSGIWADGSTHYA DTVKSRFTISRDNSKNTLYL QMNSLRAEDTAVYYCAREWQ HGPVAYWGQGTLVTVSSAST KGPEVQLVQSGAEVKKPGSS VKVSCKASGYTFTDYEIHWV RQAPGQGLEWMGVNDPESGG TFYNQKFDGRVTLTADESTS TAYMELSSLRSEDTAVYYCT RYSKWDSFDGMDYWGQGTTV TVSS |
| HMAK195-24 Vh | SEQ ID NO.: 731 | EVQLVESGGGLVQPGGSLRL SCAASGFTFSNYGVEWVRQA PGKGLEWVSGIWADGSTHYA |

TABLE 17-continued

Sequences of variable and constant regions of TNF/IL-17 DVD-Ig binding proteins.

| Protein region | Sequence Identifier | 12345678901234567890 |
|---|---|---|
| | | DTVKSRFTISRDNSKNTLYL<br>QMNSLRAEDTAVYYCAREWQ<br>HGPVAYWGQGTLVTVSS |
| LINKER | SEQ ID NO.: 732 | ASTKGP |
| H10F7-M11 Vh | SEQ ID NO.: 733 | EVQLVQSGAEVKKPGSSVKV<br>SCKASGYTFTDYEIHWVRQA<br>PGQGLEWMGVNDPESGGTFY<br>NQKFDGRVTLTADESTSTAY<br>MELSSLRSEDTAVYYCTRYS<br>KWDSFDGMDYWGQGTTVTVS<br>S |
| CH CG1 Z NONA | SEQ ID NO.: 734 | ASTKGPSVFPLAPSSKSTSG<br>GTAALGCLVKDYFPEPVTVS<br>WNSGALTSGVHTFPAVLQSS<br>GLYSLSSVVTVPSSSLGTQT<br>YICNVNHKPSNTKVDKKVEP<br>KSCDKTHTCPPCPAPELLGG<br>PSVFLFPPKPKDTLMISRTP<br>EVTCVVVDVSHEDPEVKFNW<br>YVDGVEVHNAKTKPREEQYN<br>STYRVVSVLTVLHQDWLNGK<br>EYKCKVSNKALPAPIEKTIS<br>KAKGQPREPQVYTLPPSREE<br>MTKNQVSLTCLVKGFYPSDI<br>AVEWESNGQPENNYKTTPPV<br>LDSDGSFFLYSKLTVDKSRW<br>QQGNVFSCSVMHEALHNHYT<br>QKSLSLSPGK |
| DVD LIGHT<br>VARIABLE<br>HMAK195-24-SS-<br>H10F7-M11DVD | SEQ ID NO.: 735 | DIQMTQSPSSLSASVGDRVT<br>ITCKASQLVSSAVAWYQQKP<br>GKAPKLLIYWASTLHTGVPS<br>RFSGSGSGTDFTLTISSLQP<br>EDFATYYCQQHYRTPFTFGQ<br>GTKLEIKR<u>TVAAP</u>DIQMTQS<br>PSSLSASVGDRVTITCRASS<br>GIISYIDWFQQKPGKAPKRL<br>IYATFDLASGVPSRFSGSGS<br>GTDYTLTISSLQPEDFATYY<br>CRQVGSYPETFGQGTKLEIK<br>R |
| HMAK195-24 VL | SEQ ID NO.: 736 | DIQMTQSPSSLSASVGDRVT<br>ITCKASQLVSSAVAWYQQKP<br>GKAPKLLIYWASTLHTGVPS<br>RFSGSGSGTDFTLTISSLQP<br>EDFATYYCQQHYRTPFTFGQ<br>GTKLEIKR |
| LINKER | SEQ ID NO.: 737 | TVAAP |
| H10F7-M11VL | SEQ ID NO.: 738 | DIQMTQSPSSLSASVGDRVT<br>ITCRASSGIISYIDWFQQKP<br>GKAPKRLIYATFDLASGVPS<br>RFSGSGSGTDYTLTISSLQP<br>EDFATYYCRQVGSYPETFGQ<br>GTKLEIKR |
| CL | SEQ ID NO.: 739 | TVAAPSVFIFPPSDEQLKSG<br>TASVVCLLNNFYPREAKVQW<br>KVDNALQSGNSQESVTEQDS<br>KDSTYSLSSTLTLSKADYEK<br>HKVYACEVTHQGLSSPVTKS<br>FNRGEC |
| DVD HEAVY<br>VARIABLE<br>HMAK199-4-SS-<br>H10F7-M11 DVD | SEQ ID NO.: 740 | EVQLVQSGAEVKKPGASVKV<br>SCKASGYTFNNYGIIWVRQA<br>PGQGLEWMGWINTYTGKPTY<br>AQKFQGRVTMTTDTSTSTAY<br>MELSSLRSEDTAVYYCARKL<br>FNTVAVTDNAMDYWGQGTTV<br>TVSS<u>ASTKGP</u>EVQLVQSGAE |

TABLE 17-continued

Sequences of variable and constant regions of TNF/IL-17 DVD-Ig binding proteins.

| Protein region | Sequence Identifier | 12345678901234567890 |
|---|---|---|
| | | VKKPGSSVKVSCKASGYTFT DYEIHWVRQAPGQGLEWMGV NDPESGGTFYNQKFDGRVTL TADESTSTAYMELSSLRSED TAVYYCTRYSKWDSFDGMDY WGQGTTVTVSS |
| HMAK199-4 Vh | SEQ ID NO.: 741 | EVQLVQSGAEVKKPGASVKV SCKASGYTFNNYGIIWVRQA PGQGLEWMGWINTYTGKPTY AQKFQGRVTMTTDTSTSTAY MELSSLRSEDTAVYYCARKL FNTVAVTDNAMDYWGQGTTV TVSS |
| LINKER | SEQ ID NO.: 742 | ASTKGP |
| H10F7-M11 Vh | SEQ ID NO.: 743 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS S |
| CH CG1 Z NONA | SEQ ID NO.: 744 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE HMAK199-4-SS-H10F7-M11DVD | SEQ ID NO.: 745 | DIQMTQSPSSLSASVGDRVT ITCRASQDIENYLNWYQQKP GKAPKLLIYYTSRLQSGVPS RFSGSGSGTDFTLTISSLQP EDFATYFCQQGNTQPPTFGQ GTKLEIKRTVAAPDIQMTQS PSSLSASVGDRVTITCRASS GIISYIDWFQQKPGKAPKRL IYATFDLASGVPSRFSGSGS GTDYTLTISSLQPEDFATYY CRQVGSYPETFGQGTKLEIK R |
| HMAK199-4 VL | SEQ ID NO.: 746 | DIQMTQSPSSLSASVGDRVT ITCRASQDIENYLNWYQQKP GKAPKLLIYYTSRLQSGVPS RFSGSGSGTDFTLTISSLQP EDFATYFCQQGNTQPPTFGQ GTKLEIKR |
| LINKER | SEQ ID NO.: 747 | GGSGGGGSG |
| H10F7-M11VL | SEQ ID NO.: 748 | DIQMTQSPSSLSASVGDRVT ITCRASSGIISYIDWFQQKP GKAPKRLIYATFDLASGVPS RFSGSGSGTDYTLTISSLQP EDFATYYCRQVGSYPETFGQ GTKLEIKR |
| CL | SEQ ID NO.: 749 | TVAAPSVFIFPPSDEQLKSG TASVVCLLNNFYPREAKVQW KVDNALQSGNSQESVTEQDS |

TABLE 17-continued

Sequences of variable and constant regions of TNF/IL-17 DVD-Ig binding proteins.

| Protein region | Sequence Identifier | 12345678901234567890 |
|---|---|---|
|  |  | KDSTYSLSSTLTLSKADYEK HKVYACEVTHQGLSSPVTKS FNRGEC |
| DVD HEAVY VARIABLE H10F7-M11- HMAK199-4.4 DVD | SEQ ID NO.: 750 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS SASTKGPEVQLVQSGAEVKK PGASVKVSCKASGYTFNNYG IIWVRQAPGQGLEWMGWINT YTGKPTYAQKFQGRVTMTTD TSTSTAYMELSSLRSEDTAV YYCARKLFNTVAVTDNAMDY WGQGTTVTVSS |
| H10F7-M11 Vh | SEQ ID NO.: 751 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS S |
| LINKER | SEQ ID NO.: 752 | ASTKGP |
| HMAK199-4 Vh | SEQ ID NO.: 753 | EVQLVQSGAEVKKPGASVKV SCKASGYTFNNYGIIWVRQA PGQGLEWMGWINTYTGKPTY AQKFQGRVTMTTDTSTSTAY MELSSLRSEDTAVYYCARKL FNTVAVTDNAMDYWGQGTTV TVSS |
| CH CG1 Z NONA | SEQ ID NO.: 754 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE H10F7-M11- HMAK199-4.4 DVD | SEQ ID NO.: 755 | DIQMTQSPSSLSASVGDRVT ITCRASSGIISYIDWFQQKP GKAPKRLIYATFDLASGVPS RFSGSGSGTDYTLTISSLQP EDFATYYCRQVGSYPETFGQ GTKLEIKRTVAAPDIQMTQS PSSLSASVGDRVTITCRASQ DIENYLNWYQQKPGKAPKLL IYYTSRLQSGVPSRFSGSGS GTDFTLTISSLQPEDFATYF CQQGNTQPPTFGQGTKLEIK R |
| H10F7-M11 VL | SEQ ID NO.: 756 | DIQMTQSPSSLSASVGDRVT ITCRASQDIENYLNWYQQKP GKAPKLLIYYTSRLQSGVPS RFSGSGSGTDFTLTISSLQP EDFATYFCQQGNTQPPTFGQ GTKLEIKR |

TABLE 17-continued

Sequences of variable and constant regions of TNF/IL-17 DVD-Ig binding proteins.

| Protein region | Sequence Identifier | 12345678901234567890 |
|---|---|---|
| LINKER | SEQ ID NO.: 757 | TVAAP |
| HMAK199-4 VL | SEQ ID NO.: 758 | DIQMTQSPSSLSASVGDRVT ITCRASQDIENYLNWYQQKP GKAPKLLIYYTSRLQSGVPS RFSGSGSGTDFTLTISSLQP EDFATYFCQQGNTQPPTFGQ GTKLEIKR |
| CL | SEQ ID NO.: 759 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE H10F7-M11- HMAK199-4.8 DVD | SEQ ID NO.: 760 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS SGGGGSGGGGSEVQLVQSGA EVKKPGASVKVSCKASGYTF NNYGIIWVRQAPGQGLEWMG WINTYTGKPTYAQKFQGRVT MTTDTSTSTAYMELSSLRSE DTAVYYCARKLFNTVAVTDN AMDYWGQGTTVTVSS |
| H10F7-M11 Vh | SEQ ID NO.: 761 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS S |
| LINKER | SEQ ID NO.: 762 | GGGGSGGGGS |
| HMAK199-4 Vh | SEQ ID NO.: 763 | EVQLVQSGAEVKKPGASVKV SCKASGYTFNNYGIIWVRQA PGQGLEWMGWINTYTGKPTY AQKFQGRVTMTTDTSTSTAY MELSSLRSEDTAVYYCARKL FNTVAVTDNAMDYWGQGTTV TVSS |
| CH CG1 Z NONA | SEQ ID NO.: 764 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE H10F7-M11- HMAK199-4.8 DVD | SEQ ID NO.: 765 | DIQMTQSPSSLSASVGDRVT ITCRASSGIISYIDWFQQKP GKAPKRLIYATFDLASGVPS RFSGSGSGTDYTLTISSLQP EDFATYYCRQVGSYPETFGQ GTKLEIKRGGSGGGGSGDIQ MTQSPSSLSASVGDRVTITC RASQDIENYLNWYQQKPGKA PKLLIYYTSRLQSGVPSRFS |

TABLE 17-continued

Sequences of variable and constant regions of TNF/IL-17 DVD-Ig binding proteins.

| Protein region | Sequence Identifier | 12345678901234567890 |
|---|---|---|
| | | GSGSGTDFTLTISSLQPEDF ATYFCQQGNTQPPTFGQGTK LEIKR |
| H10F7-M11 VL | SEQ ID NO.: 766 | DIQMTQSPSSLSASVGDRVT ITCRASSGIISYIDWFQQKP GKAPKRLIYATFDLASGVPS RFSGSGSGTDYTLTISSLQP EDFATYYCRQVGSYPETFGQ GTKLEIKR |
| LINKER | SEQ ID NO.: 767 | GGSGGGGSG |
| H HMAK199-4VL | SEQ ID NO.: 768 | DIQMTQSPSSLSASVGDRVT ITCRASQDIENYLNWYQQKP GKAPKLLIYYTSRLQSGVPS RFSGSGSGTDFTLTISSLQP EDFATYFCQQGNTQPPTFGQ GTKLEIKR |
| CL | SEQ ID NO.: 769 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE HMAK199-1-h10F7-M11.8 QL DVD | SEQ ID NO.: 770 | EVQLVQSGAEVKKPGASVKV SCKASGYTFANYGIIWVRQA PGQGLEWMGWINTYTGKPTY AQKFQGRVTMTTDTSTSTAY MELSSLRSEDTAVYYCARKL FTTMDVTDNAMDYWGQGTTV TVSSGGGGSGGGGSEVQLVQ SGAEVKKPGSSVKVSCKASG YTFTDYEIHWVRQAPGQGLE WMGVNDPESGGTFYNQKFDG RVTLTADESTSTAYMELSSL RSEDTAVYYCTRYSKWDSFD GMDYWGQGTTVTVSS |
| HMAK199-1 Vh | SEQ ID NO.: 771 | EVQLVQSGAEVKKPGASVKV SCKASGYTFANYGIIWVRQA PGQGLEWMGWINTYTGKPTY AQKFQGRVTMTTDTSTSTAY MELSSLRSEDTAVYYCARKL FTTMDVTDNAMDYWGQGTTV TVSS |
| LINKER | SEQ ID NO.: 772 | GGGGSGGGGS |
| H10F7-M11 Vh | SEQ ID NO.: 773 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS S |
| CH CG1 (234, 235) MUT, QL, Z NONA | SEQ ID NO.: 774 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDQLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV |

TABLE 17-continued

Sequences of variable and constant regions of TNF/IL-17 DVD-Ig binding proteins.

| Protein region | Sequence Identifier | 12345678901234567890 |
|---|---|---|
| | | LDSDGSFFLYSKLTVDKSRW QQGNVFSCSVLHEALHNHYT QKSLSLSPGK |
| DVD HEAVY VARIABLE HMAK199-1-h10F7-M11.8 YTE DVD | SEQ ID NO.: 775 | EVQLVQSGAEVKKPGASVKV SCKASGYTFANYGIIWVRQA PGQGLEWMGWINTYTGKPTY AQKFQGRVTMTTDTSTSTAY MELSSLRSEDTAVYYCARKL FTTMDVTDNAMDYWGQGTTV TVSSGGGGSGGGGSEVQLVQ SGAEVKKPGSSVKVSCKASG YTFTDYEIHWVRQAPGQGLE WMGVNDPESGGTFYNQKFDG RVTLTADESTSTAYMELSSL RSEDTAVYYCTRYSKWDSFD GMDYWGQGTTVTVSS |
| HMAK199-1 Vh | SEQ ID NO.: 776 | EVQLVQSGAEVKKPGASVKV SCKASGYTFANYGIIWVRQA PGQGLEWMGWINTYTGKPTY AQKFQGRVTMTTDTSTSTAY MELSSLRSEDTAVYYCARKL FTTMDVTDNAMDYWGQGTTV TVSS |
| LINKER | SEQ ID NO.: 777 | GGGGSGGGGS |
| H10F7-M11 Vh | SEQ ID NO.: 778 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS S |
| CH CG1 (234, 235) MUT, YTE, Z NONA | SEQ ID NO.: 779 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDTLYITREP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD HEAVY VARIABLE HMAK199-1-h10F7-M10.8 QL DVD | SEQ ID NO.: 780 | EVQLVQSGAEVKKPGASVKV SCKASGYTFANYGIIWVRQA PGQGLEWMGWINTYTGKPTY AQKFQGRVTMTTDTSTSTAY MELSSLRSEDTAVYYCARKL FTTMDVTDNAMDYWGQGTTV TVSSGGGGSGGGGSEVQLVQ SGAEVKKPGSSVKVSCKASG YTFDDYEIHWVRQAPGQGLE WIGVNDPESGGTFYNQKFDG RATLTADKSTSTAYMELSSL RSEDTAVYYCTRYDKWDSFY GMDYWGQGTTVTVSS |
| HMAK199-1 Vh | SEQ ID NO.: 781 | EVQLVQSGAEVKKPGASVKV SCKASGYTFANYGIIWVRQA PGQGLEWMGWINTYTGKPTY AQKFQGRVTMTTDTSTSTAY MELSSLRSEDTAVYYCARKL FTTMDVTDNAMDYWGQGTTV TVSS |

TABLE 17-continued

Sequences of variable and constant regions of TNF/IL-17 DVD-Ig binding proteins.

| Protein region | Sequence Identifier | 12345678901234567890 |
|---|---|---|
| LINKER | SEQ ID NO.: 782 | GGGGSGGGGS |
| H10F7-M11 Vh | SEQ ID NO.: 783 | EVQLVQSGAEVKKPGSSVKV SCKASGYTFDDYEIHWVRQA PGQGLEWIGVNDPESGGTFY NQKFDGRATLTADKSTSTAY MELSSLRSEDTAVYYCTRYD KWDSFYGMDYWGQGTTVTVS S |
| CH CG1 (234, 235) MUT, QL, Z NONA | SEQ ID NO.: 784 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPEAAGG PSVFLFPPKPKDQLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVLHEALHNHYT QKSLSLSPGK |
| DVD HEAVY VARIABLE HMAK199-1-h10F7-M11.8 HC DVD wt | SEQ ID NO.: 785 | EVQLVQSGAEVKKPGASVKV SCKASGYTFANYGIIWVRQA PGQGLEWMGWINTYTGKPTY AQKFQGRVTMTTDTSTSTAY MELSSLRSEDTAVYYCARKL FTTMDVTDNAMDYWGQGTTV TVSSGGGGSGGGGSEVQLVQ SGAEVKKPGSSVKVSCKASG YTFTDYEIHWVRQAPGQGLE WMGVNDPESGGTFYNQKFDG RVTLTADESTSTAYMELSSL RSEDTAVYYCTRYSKWDSFD GMDYWGQGTTVTVSS |
| HMAK199-1 Vh | SEQ ID NO.: 786 | EVQLVQSGAEVKKPGASVKV SCKASGYTFANYGIIWVRQA PGQGLEWMGWINTYTGKPTY AQKFQGRVTMTTDTSTSTAY MELSSLRSEDTAVYYCARKL FTTMDVTDNAMDYWGQGTTV TVSS |
| LINKER | SEQ ID NO.: 787 | GGGGSGGGGS |
| H10F7-M11 Vh | SEQ ID NO.: 788 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS S |
| CH CG1 Z NONA | SEQ ID NO.: 789 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV |

TABLE 17-continued

Sequences of variable and constant regions of TNF/IL-17 DVD-Ig binding proteins.

| Protein region | Sequence Identifier | 12345678901234567890 |
|---|---|---|
| | | LDSDGSFFLYSKLTVDKSRW QQGNVFSCSVMHEALHNHYT QKSLSLSPGK |
| DVD HEAVY VARIABLE HMAK199-4-h10F7-M11.8 HC DVD wt | SEQ ID NO.: 790 | EVQLVQSGAEVKKPGASVKV SCKASGYTFNNYGIIWVRQA PGQGLEWMGWINTYTGKPTY AQKFQGRVTMTTDTSTSTAY MELSSLRSEDTAVYYCARKL FNTVAVTDNAMDYWGQGTTV TVSSGGGGSGGGGSEVQLVQ SGAEVKKPGSSVKVSCKASG YTFTDYEIHWVRQAPGQGLE WMGVNDPESGGTFYNQKFDG RVTLTADESTSTAYMELSSL RSEDTAVYYCTRYSKWDSFD GMDYWGQGTTVTVSS |
| HMAK199-1 Vh | SEQ ID NO.: 791 | EVQLVQSGAEVKKPGASVKV SCKASGYTFNNYGIIWVRQA PGQGLEWMGWINTYTGKPTY AQKFQGRVTMTTDTSTSTAY MELSSLRSEDTAVYYCARKL FNTVAVTDNAMDYWGQGTTV TVSS |
| LINKER | SEQ ID NO.: 792 | GGGGSGGGGS |
| H10F7-M11 Vh | SEQ ID NO.: 793 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS S |
| CH CG1 Z NONA | SEQ ID NO.: 794 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD HEAVY VARIABLE HMAK195-21-h10F7-M11.8 HC DVD wt | SEQ ID NO.: 795 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSSGGG GSGGGGSEVQLVQSGAEVKK PGSSVKVSCKASGYTFTDYE IHWVRQAPGQGLEWMGVNDP ESGGTFYNQKFDGRVTLTAD ESTSTAYMELSSLRSEDTAV YYCTRYSKWDSFDGMDYWGQ GTTVTVSS |
| HMAK199-1 Vh | SEQ ID NO.: 796 | EVQLVESGGGLVQPGGSLRL SCAASGFTFSNYGVTWVRQA PGKGLEWVSMIWADGSTHYA SSVKGRFTISRDNSKNTLYL QMNSLRAEDTAVYYCAREWQ HGPVAYWGQGTLVTVSS |

TABLE 17-continued

Sequences of variable and constant regions of TNF/IL-17 DVD-Ig binding proteins.

| Protein region | Sequence Identifier | 12345678901234567890 |
|---|---|---|
| LINKER | SEQ ID NO.: 797 | GGGGSGGGGS |
| H10F7-M11 Vh | SEQ ID NO.: 798 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS S |
| CH CG1 Z NONA | SEQ ID NO.: 799 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD HEAVY VARIABLE HMAK195-24-h10F7-M11.8 HC DVD wt | SEQ ID NO.: 800 | EVQLVESGGGLVQPGGSLRL SCAASGFTFSNYGVEWVRQA PGKGLEWVSGIWADGSTHYA DTVKSRFTISRDNSKNTLYL QMNSLRAEDTAVYYCAREWQ HGPVAYWGQGTLVTVSSGGG GSGGGGSEVQLVQSGAEVKK PGSSVKVSCKASGYTFTDYE IHWVRQAPGQGLEWMGVNDP ESGGTFYNQKFDGRVTLTAD ESTSTAYMELSSLRSEDTAV YYCTRYSKWDSFDGMDYWGQ GTTVTVSS |
| HMAK199-1 Vh | SEQ ID NO.: 801 | EVQLVESGGGLVQPGGSLRL SCAASGFTFSNYGVEWVRQA PGKGLEWVSGIWADGSTHYA DTVKSRFTISRDNSKNTLYL QMNSLRAEDTAVYYCAREWQ HGPVAYWGQGTLVTVSS |
| LINKER | SEQ ID NO.: 802 | GGGGSGGGGS |
| H10F7-M11 Vh | SEQ ID NO.: 803 | EVQLVQSGAEVKKPGSSVKV SCKASGYTFTDYEIHWVRQA PGQGLEWMGVNDPESGGTFY NQKFDGRVTLTADESTSTAY MELSSLRSEDTAVYYCTRYS KWDSFDGMDYWGQGTTVTVS S |
| CH CG1 Z NONA | SEQ ID NO.: 804 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSREE MTKNQVSLTCLVKGFYPSDI AVEWESNGQPENNYKTTPPV |

TABLE 17-continued

Sequences of variable and constant regions of TNF/IL-17 DVD-Ig binding proteins.

| Protein region | Sequence Identifier 12345678901234567890 |
|---|---|
| | LDSDGSFFLYSKLTVDKSRW |
| | QQGNVFSCSVMHEALHNHYT |
| | QKSLSLSPGK |

DVD-Ig Heavy and Light Chain Combinations

Table 18 lists the heavy and ligh chain sequences used for the expression of different TNF/IL-17 DVD-Ig binding proteins.

TABLE 18

DVD-Ig heavy and light chain combinations

| DVD-Ig Name | Heavy chain construct | Light chain construct |
|---|---|---|
| hMAK195-21-h10F7-M11.8 DVD-Ig | hMAK195-21-GS10-h10F7-M11 HC DVD | hMAK195-21-GS10-h10F7-M11 LC DVD |
| hMAK195-24-h10F7-M11.8 DVD-Ig | hMAK195-24-GS10-h10F7-M11 HC DVD | hMAK195-24-GS10-h10F7-M11 LC DVD |
| hMAK195-21-h10F7-M10.8 DVD-Ig | hMAK195-21-GS10-h10F7-M10 HC DVD | hMAK195-21-GS10-h10F7-M10 LC DVD |
| hMAK195-24-h10F7-M10.8 DVD-Ig | hMAK195-24-GS10-h10F7-M10 HC DVD | hMAK195-24-GS10-h10F7-M10 LC DVD |
| hMAK195-21-h10F7-A6.8 DVD-Ig | hMAK195-21-GS10-h10F7-A6 HC DVD | hMAK195-21-GS10-h10F7-A6 LC DVD |
| hMAK195-24-h10F7-A6.8 DVD-Ig | hMAK195-24-GS10-h10F7-A6 HC DVD | hMAK195-24-GS10-h10F7-A6 LC DVD |
| hMAK195-21-h10F7-A16.8 DVD-Ig | hMAK195-21-GS10-h10F7-A16 HC DVD | hMAK195-21-GS10-h10F7-A6 LC DVD |
| hMAK195-24-h10F7-A16.8 DVD-Ig | hMAK195-24-GS10-h10F7-A16 HC DVD | hMAK195-24-GS10-h10F7-A6 LC DVD |
| hMAK195-21-h10F7-A11.8 DVD-Ig | hMAK195-21-GS10-h10F7-A11 HC DVD | hMAK195-21-GS10-h10F7-M11 LC DVD |
| hMAK195-24-h10F7-A11.8 DVD-Ig | hMAK195-24-GS10-h10F7-A11 HC DVD | hMAK195-24-GS10-h10F7-M11 LC DVD |
| hMAK195-21-h10F7-B13.8 DVD-Ig | hMAK195-21-GS10-h10F7-B13 HC DVD | hMAK195-21-GS10-h10F7-M11 LC DVD |
| hMAK195-24-h10F7-B13.8 DVD-Ig | hMAK195-24-GS10-h10F7-B13 HC DVD | hMAK195-24-GS10-h10F7-M11 LC DVD |
| hMAK195-21-h10F7-B20.8 DVD-Ig | hMAK195-21-GS10-h10F7-B20 HC DVD | hMAK195-21-GS10-h10F7-M11 LC DVD |
| hMAK195-24-h10F7-B20.8 DVD-Ig | hMAK195-24-GS10-h10F7-B20 HC DVD | hMAK195-24-GS10-h10F7-M11 LC DVD |
| h10F7-M10-hMAk195-21.8 DVD-Ig | h10F7-M10-GS10-MAK195-21HC DVD | h10F7-M10-GS10-MAK195-21 LC DVD |
| h10F7-M10-hMAk195-24.8 DVD-Ig | h10F7-M10-GS10-MAK195-24HC DVD | h10F7-M10-GS10-MAK195-24 LC DVD |
| hMAK199-1-h10F7-M11.8 DVD-Ig | hMAK199-1-GS10-h10F7-M11 HC DVD | hMAK199-1-GS10-h10F7-M11 LC DVD |
| hMAK199-1-h10F7-M10.8 DVD-Ig | hMAK199-1-GS10-h10F7-M10 HC DVD | hMAK199-1-GS10-h10F7-M10 LC DVD |
| hMAK199-10-h10F7-M11.8 DVD-Ig | hMAK199-10-GS10-h10F7-M11 HC DVD | hMAK199-10-GS10-h10F7-M11 LC DVD |
| hMAK199-10-h10F7-M10.8 DVD-Ig | hMAK199-10-GS10-h10F7-M10 HC DVD | hMAK199-10-GS10-h10F7-M10 LC DVD |
| hMAK199-6-h10F7-M11.8 DVD-Ig | hMAK199-8-GS10-h10F7-M11 HC DVD | hMAK199-6-GS10-h10F7-M11 LC DVD |
| hMAK199-6-h10F7-M10.8 DVD-Ig | hMAK199-6-GS10-h10F7-M10 HC DVD | hMAK199-6-GS10-h10F7-M10 LC DVD |
| hMAK199-4-h10F7-M11.8 DVD-Ig | hMAK199-4-GS10-h10F7-M11 HC DVD | hMAK199-4-GS10-h10F7-M11 LC DVD |
| hMAK195-24-h10F7-M11.4 DVD-Ig wt | hMAK195-24-SS-h10F7-M11 HC DVD wt | hMAK195-24-SS-h10F7-M11 LC DVD |
| hMAK199-4-h10F7-M11.4 DVD-Ig wt | hMAK199-4-SS-h10F7-M11 HC DVD wt | hMAK199-4-SS-h10F7-M11 LC DVD |
| h10F7-M11-hMAk199-4.4 DVD-Ig wt | h10F7-M11-SS-MAK199-4HC DVD wt | h10F7-M11-SS-MAK199-4HC DVD |
| h10F7-M11-hMAK199-4.8 DVD-Ig wt | h10F7-M11-GS10-MAK199-4HC DVD wt | h10F7-M11-GS10-MAK199-4HC DVD |
| hMAK199-1-h10F7-M11.8 QL DVD-Ig | hMAK199-1-GS10-h10F7-M11 QL HC DVD | hMAK199-1-GS10-h10F7-M11 LC DVD |

TABLE 18-continued

DVD-Ig heavy and light chain combinations

| DVD-Ig Name | Heavy chain construct | Light chain construct |
|---|---|---|
| hMAK199-1-h10F7-M11.8 YTE DVD-Ig | hMAK199-1-GS10-h10F7-M11 YTE HC DVD | hMAK199-1-GS10-h10F7-M11 LC DVD |
| hMAK199-1-h10F7-M10.8 QL DVD-Ig | hMAK199-1-GS10-h10F7-M10 QL HC DVD | hMAK199-1-GS10-h10F7-M10 LC DVD |
| hMAK199-1-h10F7-M11.8 DVD-Ig wt | hMAK199-1-GS10-h10F7-M10 HC DVD wt | hMAK199-1-GS10-h10F7-M10 LC DVD wt |
| hMAK199-4-h10F7-M11.8 DVD-Ig wt | hMAK199-4-GS10-h10F7-M10 HC DVD wt | hMAK199-4-GS10-h10F7-M10 LC DVD |
| hMAK195-21-h10F7-M11.8 DVD-Ig wt | hMAK195-21-GS10-h10F7-M11 HC DVD wt | hMAK195-21-GS10-h10F7-M11 LC DVD |
| hMAK195-24-h10F7-M11.8 DVD-Ig wt | hMAK195-24-GS10-h10F7-M11 HC DVD wt | hMAK195-24-GS10-h10F7-M11 LC DVD |

Functional Characterization of TNF/IL-17 DVD-Ig Proteins
IL-17 Enzyme-Linked Immunosorbent Assay Protocol The following protocol is used to characterize the binding of TNF/IL-17 DVD-Ig proteins to human TNF and IL-17 by enzyme-linked immunosorbent assay (ELISA). An ELISA plate was coated with 50 μl per well of goat anti mouse IgG-Fc at 2 μg/ml, overnight at 4° C. The plate was washed 3 times with PBS/Tween. 50 μl Mab diluted to 1 μg/ml in PBS/0.1% BSA was added to appropriate wells and incubated for 1 hour at room temperature (RT). The plate was washed 3 times with PBS/Tween. 50 μl of serial diluted biotin-human TNF or IL-17 was added to appropriate wells and incubated for 1 hour at RT. The plate was washed 3 times with PBS/Tween. 50 μl of streptavidin-HRP diluted 1:10,000 in PBS/0.1% BSA was added to appropriate wells and incubated for 1 hour at RT. The plate was washed 3 times with PBS/Tween. 50 μl of TMB was added to appropriate wells and the reaction allowed to proceed for 1 minute. The reaction was stopped with 50 μl/well 2N $H_2SO_4$ and the absorbance read at 450 nm. Results are shown in Table 19.

TABLE 19

Binding of TNF/IL-17 DVD-Ig proteins to human TNF and IL-17 by ELISA

| DVD-Ig Name | EC50 in hIL17A ELISA (pM) | EC50 in h TNF ELISA (pM) |
|---|---|---|
| hMAK195-21-h10F7-M11.8 DVD-Ig | 95 | 110 |
| hMAK195-24-h10F7-M11.8 DVD-Ig | 84 | 200 |
| hMAK195-21-h10F7-M10.8 DVD-Ig | 100 | 90 |
| hMAK195-24-h10F7-M10.8 DVD-Ig | 100 | 200 |
| hMAK195-21-h10F7-A6.8 DVD-Ig | 130 | 13 |
| hMAK195-24-h10F7-A6.8 DVD-Ig | 188 | 12 |
| hMAK195-21-h10F7-A16.8 DVD-Ig | 230 | 34 |
| hMAK195-24-h10F7-A16.8 DVD-Ig | 93 | 66 |
| hMAK195-21-h10F7-A11.8 DVD-Ig | 300 | 300 |
| hMAK195-24-h10F7-A11.8 DVD-Ig | 295 | 295 |
| hMAK195-21-h10F7-B13.8 DVD-Ig | 200 | 373 |
| hMAK195-21-h10F7-B20.8 DVD-Ig | 242 | 300 |
| hMAK199-1-h10F7-M10.8 DVD-Ig | 81 | 220 |
| hMAK199-1-h10F7-M11.8 DVD-Ig | 78 | 220 |
| hMAK199-10-h10F7-M10.8 DVD-Ig | 79 | 220 |
| hMAK199-10-h10F7-M11.8 DVD-Ig | 133 | 205 |
| hMAK199-6-h10F7-M10.8 DVD-Ig | 163 | 168 |
| hMAK199-6-h10F7-M11.8 DVD-Ig | 104 | 139 |
| hMAK199-4-h10F7-M11.8 DVD-Ig | 130 | 30 |
| hMAK195-24-h10F7-M11.4 DVD-Ig wt | >500 | 200 |
| hMAK199-4-h10F7-M11.4 DVD-Ig wt | >500 | 200 |
| h10F7-M11-hMAk199-4.4 DVD-Ig wt | 40 | >100 |
| h10F7-M11-hMAK199-4.8 DVD-Ig wt | 50 | >100 |
| hMAK199-1-h10F7-M11.8 QL DVD-Ig | 142 | 119 |
| hMAK199-1-h10F7-M11.8 YTE DVD-Ig | 50 | 100 |
| hMAK199-1-h10F7-M10.8 QL DVD-Ig | 63 | 183 |
| hMAK199-1-h10F7-M11.8 DVD-Ig wt | 88 | 95 |
| hMAK199-4-h10F7-M11.8 DVD-Ig wt | 100 | 61 |
| hMAK195-21-h10F7-M11.8 DVD-Ig wt | 110 | 95 |
| hMAK195-24-h10F7-M11.8 DVD-Ig wt | 120 | 141 |

Affinity Measurement of Anti TNF/IL-17 DVD-Ig by Surface Plasmon Resonance

The binding of antibodies to purified recombinant IL-17 and TNFα proteins were determined by surface plasmon resonance-based measurements with a Biacore® T200 instrument (GE Healthcare) using running HBS-EP (10 mM HEPES [pH 7.4], 150 mM NaCl, 3 mM EDTA, and 0.005% surfactant P20) containing 0.1 mg/ml BSA at 25° C. All chemicals were obtained from Biacore® AB (GE Healthcare) or otherwise from a different source as described in the text. Approximately 5000 RU of goat anti-human IgG (Fcγ) fragment specific polyclonal antibody (Pierce Biotechnology Inc, Rockford, Ill.) diluted in 10 mM sodium acetate (pH 4.5) was directly immobilized across a CM5 research grade biosensor chip using a standard amine coupling kit according to manufacturer's instructions and procedures at 25 ug/ml. Unreacted moieties on the biosensor surface were blocked with ethanolamine. Modified carboxymethyl dextran surface in flowcell 2, 3 and 4 were used as a reaction surface. Modified carboxymethyl dextran with goat IgG in flow cell 1 was used as the reference surface. For kinetic analysis, rate equations derived from the 1:1 Langmuir binding model were fitted simultaneously to association and dissociation phases of all six injections (using global fit analysis with local float for Rmax) with the use of Biacore T200 Evaluation software v.1.0. Purified antibodies were diluted in HEPES-buffered saline for capture across goat anti-human IgG specific reaction surfaces. Antibodies to be captured as ligand (1-5 μg/ml) were injected over reaction matrices at a flow rate of 50 μl/minute. Association phase was monitored for 5 minutes, while dissociation phase was monitored for 10-60 minutes to accommodate for slower off-rates. The association and dissociation rate constants, ka (unit M-1 s-1) and kd (unit s-1) were determined under a continuous flow rate of 50 μl/minute. Rate constants were derived by making kinetic binding measurements at six different antigen concentrations ranging from 0.78 nM to 100 nM, depending on the species of IL-17 or TNFα tested. The association ka, dissociation rate kd and equilibrium dissociation constant KD were calculated with the use of the same Biacore T200 Evaluation software v.1.0.

were washed with PBS, counted, and resuspended at 1E6 cells/mL in assay media containing 4 μg/mL actinomycin D. The cells were seeded in a 96-well plate (Costar#3599) at a volume of 50 μL and 5E4 cells/well. Wells received 50 μL of assay media, bringing the volume to 100 μL.

TABLE 20

Affinity of TNF/IL-17 DVD-Ig proteins to IL-17 by Biacore

| DVD-Ig Name | Human IL17AA | | | Cyno IL17AA | | |
|---|---|---|---|---|---|---|
| | $k_a$ | $k_d$ | $K_D$ | $k_a$ | $k_d$ | $K_D$ |
| hMAK195-21-h10F7-M11.8 DVD-Ig | 2.42E+05 | 1.05E−05 | 4.34E−11 | 2.48E+05 | 6.28E−06 | 2.53E−11 |
| hMAK195-24-h10F7-M11.8 DVD-Ig | 2.51E+05 | 1.07E−05 | 4.27E−11 | 2.59E+05 | 6.25E−06 | 2.41E−11 |
| hMAK199-1-h10F7-M11.8 DVD-Ig | 3.29E+05 | 1.11E−05 | 3.37E−11 | 2.99E+05 | 2.15E−06 | 7.22E−12 |
| hMAK199-4-h10F7-M11.8 DVD-Ig | 3.23E+05 | 8.76E−06 | 2.71E−11 | 2.99E+05 | 2.57E−06 | 8.61E−12 |
| hMAK199-1-h10F7-M11.8 QL DVD-Ig | 2.21E+05 | <1.00E−06 | <4.52E−12 | | | |
| hMAK199-1-h10F7-M11.8 DVD-Ig wt | 3.07E+05 | 7.90E−06 | 2.57E−11 | 2.67E+05 | 1.18E−06 | 4.44E−12 |
| hMAK199-4-h10F7-M11.8 DVD-Ig wt | 3.11E+05 | 3.11E+05 | 2.59E−11 | 2.78E+05 | 3.15E−06 | 1.13E−11 |
| hMAK195-21-h10F7-M11.8 DVD-Ig wt | 2.39E+05 | 9.26E−06 | 3.86E−11 | 2.03E+05 | 2.21E−06 | 1.09E−11 |
| hMAK195-24-h10F7-M11.8 DVD-Ig wt | 2.33E+05 | 8.48E−06 | 3.63E−11 | 2.14E+05 | 4.29E−06 | 2.01E−11 |

TABLE 21

Affinity of TNF/IL-17 DVD-Ig proteins to TNF by Biacore

| DVD-Ig Name | Human TNFa | | | Rhesus TNFa | | |
|---|---|---|---|---|---|---|
| | $k_a$ | $k_d$ | $K_D$ | $k_a$ | $k_d$ | $K_D$ |
| hMAK195-21-h10F7-M11.8 DVD-Ig | 6.29E+06 | 5.70E−05 | 9.06E−12 | 5.21E+06 | 1.32E−04 | 2.54E−11 |
| hMAK195-24-h10F7-M11.8 DVD-Ig | 5.62E+06 | 4.69E−05 | 8.36E−12 | 4.78E+06 | 3.43E−04 | 7.16E−11 |
| hMAK199-1-h10F7-M11.8 DVD-Ig | 4.31E+06 | 2.37E−05 | 5.50E−12 | 2.21E+06 | 2.39E−05 | 1.08E−11 |
| hMAK199-4-h10F7-M11.8 DVD-Ig | 5.61E+06 | 1.73E−05 | 3.08E−12 | 2.91E+06 | 2.25E−05 | 7.72E−12 |
| hMAK199-1-h10F7-M11.8 DVD-Ig wt | 4.28E+06 | 2.40E−05 | 5.61E−12 | 2.20E+06 | 3.03E−05 | 1.37E−11 |
| hMAK199-4-h10F7-M11.8 DVD-Ig wt | 5.80E+06 | 1.77E−05 | 3.06E−12 | 3.05E+06 | 2.48E−05 | 8.13E−12 |
| hMAK195-21-h10F7-M11.8 DVD-Ig wt | 5.83E+06 | 4.97E−05 | 8.52E−12 | 4.56E+06 | 1.41E−04 | 3.10E−11 |
| hMAK195-24-h10F7-M11.8 DVD-Ig wt | 5.62E+06 | 4.86E−05 | 8.65E−12 | 6.12E+06 | 4.60E−04 | 7.52E−11 |

TNF Neutralization Potency of TNF/IL-17 DVD-Ig Molecules

L929 Bioassay for Measuring TNF Neutralization Potency

Human TNF Lot No. 1277249 (1.85 mg/mL) was prepared at Abbott Bioresearch Center (Worcester, Mass., US) and received from the Biologics Pharmacy. Actinomycin D (catalog# A1410) was purchased from Sigma Aldrich and resuspended at a stock concentration of 10 mg/mL in DMSO.

Assay Media: 10% FBS (Hyclone#SH30070.03), Gibco reagents: RPMI 1640 (#21870), 2 mM L-glutamine (#25030), 50 units/mL penicillin/50 μg/mL streptomycin (#15140), 0.1 mM MEM non-essential amino acids (#11140) and $5.5 \times 10^{-5}$ M 2-mercaptoethanol (#21985-023).

L929 cells were grown to a semi-confluent density and harvested using 0.05% tryspin (Gibco#25300). The cells A test sample was prepared as follows. The DVD-Ig™ and control IgG were diluted to a 4× concentration in assay media and serial 1:3 dilutions were performed. TNF was diluted to 400 pg/mL huTNF in assay media. DVD-Ig sample (200 μL) was added to the TNF (200 μL) in a 1:2 dilution scheme and allowed to incubate for 0.5 hour at room temperature.

To measure huTNF neutralization potency of DVD-Ig in this assay, the DVD-Ig/TNF solution was added to the plated cells at 100 μL for a final concentration of DVD-Ig at 375 nM-0.019 nM DVD-Ig. The final concentration of TNF was 100 pg/mL. The plates were incubated for 20 hours at 37° C., 5% $CO_2$. To quantitate viability, 100 μL was removed from the wells and 10 μL of WST-1 reagent (Roche cat#11644807001) was added. Plates were incubated under assay conditions for 3.5 hours, centrifuged at 500×g, and 75

μL of supernatant transferred to an ELISA plate (Costar cat#3369). The plates were read at OD 420-600 nm on a Spectromax 190 ELISA plate reader. The neutralization potency of selected TNF/IL-17 DVD-Ig binding proteins is shown in Table 22.

TABLE 22

In vitro potency for human TNF

| DVD-Ig | Potency IC50 (nM) |
|---|---|
| hMAK195-21-h10F7-M11.8 DVD-Ig | 0.013 |
| hMAK195-24-h10F7-M11.8 DVD-Ig | 0.019 |
| hMAK195-21-h10F7-A6.8 DVD-Ig | 0.019 |
| hMAK195-24-h10F7-A6.8 DVD-Ig | 0.037 |
| ShMAK195-21-h10F7-A16.8 DVD-Ig | 0.034 |
| hMAK195-24-h10F7-A16.8 DVD-Ig | 0.044 |
| hMAK199-1-h10F7-M10.8 DVD-Ig | 0.037 |
| hMAK199-1-h10F7-M11.8 DVD-Ig | .031 |
| hMAK199-10-h10F7-M10.8 DVD-Ig | 0.031 |
| hMAK199-10-h10F7-M11.8 DVD-Ig | 0.031 |
| hMAK199-6-h10F7-M10.8 DVD-Ig | 0.009 |
| hMAK199-6-h10F7-M11.8 DVD-Ig | 0.009 |
| hMAK199-4-h10F7-M11.8 DVD-Ig | .023 |
| hMAK195-24-h10F7-M11.4 DVD-Ig wt | 0.021 |
| hMAK199-4-h10F7-M11.4 DVD-Ig wt | 0.01 |
| h10F7-M11-hMAK199-4.4 DVD-Ig wt | 4.195 |
| h10F7-M11-hMAK199-4.8 DVD-Ig wt | >100 nM |
| hMAK199-1-h10F7-M11.8 QL DVD-Ig | 0.027 |
| hMAK199-1-h10F7-M11.8 DVD-Ig wt | 0.033 |
| hMAK199-4-h10F7-M11.8 DVD-Ig wt | 0.014 |
| hMAK195-21-h10F7-M11.8 DVD-Ig wt | 0.01 |
| hMAK195-24-h10F7-M11.8 DVD-Ig wt | 0.019 |
| h10F7-M10-MAK195-24DVD | 2.558 |

Assay for Human and Cyno IL-17 Induced IL-6 Secretion in Primary Human Foreskin Fibroblasts HS27

The human HS27 cell line (ATCC Accession # CRL-1634) secretes IL-6 in response to IL-17. The IL-17-induced IL-6 secretion is inhibited by neutralizing anti-IL-17 antibodies (See, e.g., *J. Immunol.*, 155: 5483-5486 (1995); *Cytokine*, 9: 794-800 (1997)).

HS27 cells were maintained in assay medium: DMEM high glucose medium (Gibco #11965) with 10% fetal bovine serum (Gibco#26140), 4 mM L-glutamine, 1 mM sodium pyruvate, penicillin G (100 U/500 ml) and streptomycin (100 μg/500 ml). Cells were grown in T150 flasks until they were about 80-90% confluent the day of the assay. Human IL-17A (R&D Systems, #317-IL/CF), or cynomolgous monkey (cyno) IL-17A (generated at Abbott) was reconstituted in sterile PBS without $Ca^{2+}$ and $Mg^{2+}$ stored frozen, freshly thawed for use and diluted to 240 pM (4×) or 4 nM (4×) for IL-17A/F in assay medium. Serial dilutions of antibodies were made in a separate plate (4× concentrations), mixed with equal volume of 240 pM (4×) of huIL-17 or cynoIL-17A or 4 nM (4×) huIL-17A/F and incubated at 37° C. for 1 hour. HS27 cells (typically about 20,000 cells in 50 μl assay medium) were added to each well of a 96-well flat-bottom tissue culture plate (Costar #3599), followed by addition of 50 μl of the pre-incubated antibody plus IL-17 mix. The final concentration of human and cynoIL-17A was 60 μM. The final concentration of human IL-17A/F was 1 nM. Cells were incubated for about 24 hours at 37° C. The media supernatants were then collected. The level of IL-17 neutralization was measured by determination of IL-6 amounts in supernatant using a commercial Meso Scale Discovery kit (cat# L411AKB-1) according to manufacturer's instruction. IC50 values were obtained using logarithm of antibody versus IL-6 amount variable slope fit.

Assay for IL-17 Induced IL-6 Secretion from Murine Embryonic Fibroblast Cell Line (NIH3T3)

The murine NIH3T3 cell line (ATCC Accession # CRL-1658) secretes IL-6 in response to mouse, rat, or rabbit IL-17A when added in the presence of a low level of TNFα (R&D Systems, Cat#410-MT). The IL-17 induced IL-6 secretion is inhibited by neutralizing anti-IL-17 DVD-Ig.

NIH3T3 cells were maintained in assay medium: DMEM (Invitrogen Cat#11965-092) with 10% fetal bovine serum (Gibco#26140-079), 1% Non Essential Amino Acids, 2 mM L-glutamine, 1 mM sodium pyruvate, penicillin G (100 U/500 ml), and streptomycin (100 μg/500 ml). Cells were grown in T150 flasks until they were about 80-90% confluent the day of the assay. Rat IL17A (Prospec bio, Cat# CYT-542) was reconstituted in sterile PBS, without Ca2+ and Mg2+, with 0.1% BSA, aliquoted and stored frozen at 100 μg/mL. Rabbit IL17A (Abbott, A-1239293.0) was aliquoted and stored frozen at 260 μg/mL. Murine TNF-α was reconstituted in 0.1% BSA/PBS without $Ca^{2+}$ and $Mg^{2+}$ at a concentration of 10 μg/mL, aliquoted, and stored frozen. Freshly thawed IL-17 antibodies were diluted to 200 μg/ml (4×) in assay medium. Serial dilutions of antibodies were made in a separate plate (4× concentrations), mixed with equal volume of 40 ng/ml (4×) mouse or rat IL-17A or 100 ng/mL rabbit IL-17A, and incubated at 37° C. for 1 hour.

NIH3T3 cells (typically about 400,000 cells in 50 μl assay medium) were added to each well of a 96-well flat-bottom tissue culture plate (Costar #3599), followed by addition of 50 μl of the pre-incubated with DVD-Ig plus IL-17. Mu TNF-α at 5.5 ng/mL (10×) was added in 11 μl of media to each well. The final concentration of IL-17A was 10 ng/ml for murine and rat and 25 ng/mL for rabbit. The final concentration for mu TNFα was 0.55 ng/mL. Cells were incubated for about 24 hours at 37° C. The media supernatants were then collected. The level of IL-17 neutralization was measured by determination of IL-6 amounts in supernatant using a commercial Meso Scale Discovery kit (cat# K112AKA-4) according to manufacturer's instruction. IC50 values were obtained using logarithm of antibody versus IL-6 amount variable slope fit relative to baseline IL-6 levels induced with TNF alone.

TABLE 23

IL-6 secretion from fibroblast cell line in response to IL-17A

| DVD-Ig Name | Human | Cyno | Mouse | Rat | Rabbit |
|---|---|---|---|---|---|
| hMAK195-21-h10F7-M11.8 DVD-Ig | 207 | 30 | 47 | 490 | 219 |
| hMAK195-24-h10F7-M11.8 DVD-Ig | 200 | 36 | 33 | 251 | 206 |
| hMAK195-21-h10F7-M10.8 DVD-Ig | 200 | 49 | | | |
| hMAK195-24-h10F7-M10.8 DVD-Ig | 200 | 61 | | | |
| hMAK195-21-h10F7-A6.8 DVD-Ig | 200 | 76 | | | |
| hMAK195-24-h10F7-A6.8 DVD-Ig | 200 | 62 | | | |
| hMAK195-21-h10F7-A16.8 DVD-Ig | 200 | 78 | | | |

TABLE 23-continued

IL-6 secretion from fibroblast cell line in response to IL-17A

| DVD-Ig Name | Human | Cyno | Mouse | Rat | Rabbit |
|---|---|---|---|---|---|
| hMAK195-24-h10F7-A16.8 DVD-Ig | 200 | 81 | | | |
| hMAK195-21-h10F7-A11.8 DVD-Ig | 200 | 76 | | | |
| hMAK195-24-h10F7-A11.8 DVD-Ig | 200 | 81 | | | |
| hMAK195-21-h10F7-B13.8 DVD-Ig | 200 | 58 | | | |
| hMAK195-21-h10F7-B20.8 DVD-Ig | 200 | 44 | | | |
| hMAK199-1-h10F7-M10.8 DVD-Ig | 145 | 33 | | | |
| hMAK199-1-h10F7-M11.8 DVD-Ig | 200 | 29 | 33 | 248 | 211 |
| hMAK199-10-h10F7-M10.8 DVD-Ig | 200 | 26 | | | |
| hMAK199-10-h10F7-M11.8 DVD-Ig | 200 | 33 | | | |
| hMAK199-6-h10F7-M10.8 DVD-Ig | 200 | 31 | | | |
| hMAK199-6-h10F7-M11.8 DVD-Ig | 200 | 32 | | | |
| hMAK199-4-h10F7-M11.8 DVD-Ig | 100 | 21 | 26 | 217 | 223 |
| hMAK195-24-h10F7-M11.4 DVD-Ig wt | 200 | 170 | | | |
| hMAK199-4-h10F7-M11.4 DVD-Ig wt | 200 | 30 | | | |
| h10F7-M11-hMAk199-4.4 DVD-Ig wt | 40 | 57 | | | |
| h10F7-M11-hMAK199-4.8 DVD-Ig wt | 50 | 14 | | | |
| hMAK199-1-h10F7-M11.8 QL DVD-Ig | 100 | 24 | | | |
| hMAK199-1-h10F7-M11.8 YTE DVD-Ig | 100 | | | | |
| hMAK199-1-h10F7-M10.8 QL DVD-Ig | NA | | | | |
| hMAK199-1-h10F7-M11.8 DVD-Ig wt | 95 | 25 | 54 | 750 | 311 |
| hMAK199-4-h10F7-M11.8 DVD-Ig wt | 46 | 24 | 27 | 364 | 159 |
| hMAK195-21-h10F7-M11.8 DVD-Ig wt | 100 | 39 | 48 | 422 | 180 |
| hMAK195-24-h10F7-M11.8 DVD-Ig wt | 77 | 33 | 44 | 367 | 209 |

Therapeutic Efficacy of IL-17 Antibodies

Neutralizing Potency of IL-17 Antibodies in Acute IL-17 Induced KC Model

Several TNF/IL-17 DVD-Ig proteins were evaluated in the acute in vivo rhIL17-induced KC model. Female BALB/cJ mice were pre-dosed with antibodies intra-peritoneally (i.p.), and 18 hurs later they were injected i.p. with 3 µg rhIL17 in a 500 µL volume. After 1 hour, the mice were sacrificed, and the levels of KC were assessed by MesoScale. ED50 values for % inhibition of KC were determined. As shown in Table 24, the three DVD-Ig proteins fully neutralized IL-17 and TNF in vivo.

TABLE 24

ED50 in mouse cytokine challenge models

| DVD-Ig Name | IL-17 induced KC |
|---|---|
| hMAK199-1-h10F7-M11.8 DVD-Ig wt | 65 |
| hMAK199-4-h10F7-M11.8 DVD-Ig wt | 24 |
| hMAK195-24-h10F7-M11.8 DVD-Ig wt | 27 |

Neutralizing Potency of TNF/IL-17 DVD-Ig in rhTNF/D-Galactosamine-Induced Lethality Mouse Model The TNF arms of the TNF/IL17 DVD-Ig molecules were also evaluated in the rhTNF/D-galactosamine-induced lethality model. Female C57BL6/N mice were pre-dosed with binding protein (i.p.) and 18 hours later were challenged (i.p.) with 0.1 µg rh TNF and 20 mg D-galactosamine in 500 µL 0.9% sodium chloride and monitored for survival over 48 hours. ED50 values for percent survival were calculated. As shown in Table 25, three distinct anti-IL-17/TNF DVD-Ig constructs were tested in these models and all three constructs fully neutralized human IL-17 and human TNF induced bioactivity.

TABLE 25

ED50 in mouse cytokine challenge models

| DVD-Ig Name | LPS/D-gal induced lethality |
|---|---|
| hMAK199-1-h10F7-M11.8 DVD-Ig wt | 0.02 |
| hMAK199-4-h10F7-M11.8 DVD-Ig wt | 0.014 |
| hMAK195-24-h10F7-M11.8 DVD-Ig wt | 0.016 |

PK Bioanalytical Protocol for TNF/IL17 DVD-Ig PK Studies in Rat

Male Jugular Vein Cannulated Sprague-Dawley rats weighing approximately 280 g were administered a single dose of DVD-Ig or parental antibody at 4 mg/kg via the jugular vein cannula. Blood samples (50-100 ul) were collected from the tail vein over a period of 28 days into serum separator tubes, allowed to clot at room temperature for at least an hour, and centrifuged for 10 minutes at 4° C. Serum samples were frozen at −80° C. until analysis.

Serum samples were thawed at room temperature, centrifuged for 10 minutes at 4° C. and DVD-Ig concentrations determined by ligand binding using Meso Scale Discovery (MSD) system. Briefly, strepatavidin plates were coated with biotinylated human antigen and incubated overnight. Plates were blocked, and the DVD-Ig containing serum samples diluted with assay buffer (final serum concentration 1%), incubated on the plates for one hour and detected using Sulfo-tag-labeled goat anti-human IgG. Concentrations were calculated with the help of a standard curve using four parameter logistic fit.

Pharmacokinetic parameters for each animal were calculated with WinNonlin software Version 5.2.1 by non-compartmental analysis using linear trapezoidal fit.

TABLE 26

PK properties of TNF/IL-17 DVD-Ig molecules

| DVD-Ig Name | T½ (day) | Cmax (ug/mL) | Vss (mL/kg) | CL (mg/h/kg) |
|---|---|---|---|---|
| hMAK195-21-h10F7-M11.8 DVD-Ig | 10.4 | 153.5 | 55.5 | 0.17 |
| hMAK195-24-h10F7-M11.8 DVD-Ig | 12.0 | 159.4 | 64.3 | 0.17 |
| hMAK195-21-h10F7-M10.8 DVD-Ig | 7.2 | 149.6 | 57.9 | 0.25 |
| hMAK199-1-h10F7-M10.8 DVD-Ig | 9.2 | 132.4 | 61.2 | 0.20 |
| hMAK199-4-h10F7-M11.8 DVD-Ig | 7.8 | 110.0 | 64.5 | 0.24 |
| hMAK199-1-h10F7-M11.8 DVD-Ig wt | 11.3 | 135.8 | 56.3 | 0.14 |
| hMAK199-4-h10F7-M11.8 DVD-Ig wt | 7.7 | 125.9 | 58.9 | 0.22 |
| hMAK195-21-h10F7-M11.8 DVD-Ig wt | 9.3 | 91.3 | 87.6 | 0.28 |
| hMAK195-24-h10F7-M11.8 DVD-Ig wt | 11.4 | 86.4 | 93.6 | 0.25 |

Determination of DVD-Ig Serum Stability In Vitro

In Vitro Serum Stability Assay Protocol

Antibodies and DVD-Igs were received at concentrations of 5 mg/mL, labeled with Alexa Fluor 488 and purified using spin columns The Alexa Fluor 488 dye has a tetrafluorrophenyl (TFP) ester moiety that reacts efficiently with primary amines of proteins to form stable dye-protein conjugates. The labeled proteins have absorption and fluorescence emission maxima of approximately 494 nm and 519 nm respectively. Rat serum containing 1 mM sodium azide was used to dilute labeled proteins to 0.5 mg/mL and incubated at 37° C. for up to 7 days. Each sample was also diluted in PBS as a negative control. Samples were analyzed by size exclusion chromatography on Days 0, 1, 4 and 7 using a Superose 6 column. The formation of protein aggregates and fragments was used to monitor in-serum stability of molecules. Slopes were calculated by plotting the percentage of the area of high molecular weight aggregates versus time.

TABLE 27

Formation of DVD-Ig protein aggregates as a measure of stability

| DVD-Ig Name | Slope |
|---|---|
| hMAK199-1-h10F7-M10.8 DVD-Ig | 0.16, 0.21 |
| hMAk199-1-h10F7-M11.8 DVD-Ig | 0.41 |
| hMAk199-10-h10F7-M10.8 DVD-Ig | 0.30 |
| hMAk199-10-h10F7-M11.8 DVD-Ig | 0.12 |

Example 4

Generation of Additional DVD-Binding Proteins

DVD-binding protein molecules capable of binding two antigens are constructed using two parent monoclonal antibodies, one against human antigen A, and the other against human antigen B, selected as described herein.

Generation of a DVD-Binding Protein Having Two Linker Lengths

A constant region containing μl Fc with mutations at 234, and 235 to eliminate ADCC/CDC effector functions is used. Four different anti-A/B DVD-binding protein constructs are generated: 2 with short linker and 2 with long linker, each in two different domain orientations: $V_A$-$V_B$-C and $V_B$-$V_A$-C. The linker sequences, derived from the N-terminal sequence of human Cl/Ck or CH1 domain, are as follows:

For DVDAB constructs:

light chain (if anti-A has λ):Short linker: QPKAAP (SEQ ID NO: 15); Long linker: QPKAAPSVTLFPP (SEQ ID NO: 16)

light chain (if anti-A has λ):Short linker: TVAAP (SEQ ID NO: 13); Long linker: TVAAPSVFIFPP (SEQ ID NO: 14)

heavy chain (γ1): Short linker: ASTKGP (SEQ ID NO: 21); Long linker: ASTKGPSVFPLAP (SEQ ID NO: 22)

For DVDBA constructs:

light chain (if anti-B has λ):Short linker. QPKAAP (SEQ ID NO: 15); Long linker: QPKAAPSVTLFPP (SEQ ID NO: 16)

light chain (if anti-B has k):Short linker: TVAAP (SEQ ID NO: 13); Long linker: TVAAPSVFIFPP (SEQ ID NO: 14)

heavy chain (γ1): Short linker: ASTKGP (SEQ ID NO: 21); Long linker: ASTKGPSVFPLAP (SEQ ID NO: 22)

Heavy and light chain constructs are subcloned into the pBOS expression vector, and expressed in COS cells, followed by purification by Protein A chromatography. The purified materials are subjected to SDS-PAGE and SEC analysis.

Table 28 describes the heavy chain and light chain constructs used to express each anti-A/B DVD-binding protein.

TABLE 28

Anti-A/B DVD-Binding Protein Constructs

| DVD protein | Heavy chain construct | Light chain construct |
|---|---|---|
| DVDABSL | DVDABHC-SL | DVDABLC-SL |
| DVDABLL | DVDABHC-LL | DVDABLC-LL |
| DVDBASL | DVDBAHC-SL | DVDBALC-SL |
| DVDBALL | DVDBAHC-LL | DVDBALC-LL |

INCORPORATION BY REFERENCE

The present disclosure incorporates by reference in their entirety techniques well known in the field of molecular biology and drug delivery. These techniques include, but are not limited to, techniques described in the following publications:

Ausubel et al. (eds.), CURRENT PROTOCOLS IN MOLECULAR BIOLOGY, John Wiley &Sons, NY (1993);

Ausubel, F. M. et al. eds., SHORT PROTOCOLS IN MOLECULAR BIOLOGY (4th Ed. 1999) John Wiley & Sons, NY. (ISBN 0-471-32938-X);

CONTROLLED DRUG BIOAVAILABILITY, DRUG PRODUCT DESIGN AND PERFORMANCE, Smolen and Ball (eds.), Wiley, New York (1984);

Giege, R. and Ducruix, A. Barrett, CRYSTALLIZATION OF NUCLEIC ACIDS AND PROTEINS, a Practical Approach, $2^{nd}$ ea., pp. 20 1-16, Oxford University Press, New York, N.Y., (1999);

Goodson, in MEDICAL APPLICATIONS OF CONTROLLED RELEASE, vol. 2, pp. 115-138 (1984);

Hammerling, et al., in: MONOCLONAL ANTIBODIES AND T-CELL HYBRIDOMAS 563-681 (Elsevier, N.Y., 1981;

Harlow et al., ANTIBODIES: A LABORATORY MANUAL, (Cold Spring Harbor Laboratory Press, $2^{nd}$ ed. 1988);

Kabat et al., SEQUENCES OF PROTEINS OF IMMUNOLOGICAL INTEREST (National Institutes of Health, Bethesda, Md. (1987) and (1991);

Kabat, E. A., et al. (1991) SEQUENCES OF PROTEINS OF IMMUNOLOGICAL INTEREST, Fifth Edition, U.S. Department of Health and Human Services, NIH Publication No. 91-3242;

Kontermann and Dubel eds., ANTIBODY ENGINEERING (2001) Springer-Verlag. New York. 790 pp. (ISBN 3-540-41354-5);

Kriegler, Gene Transfer and Expression, A Laboratory Manual, Stockton Press, NY (1990);

Lu and Weiner eds., CLONING AND EXPRESSION VECTORS FOR GENE FUNCTION ANALYSIS (2001) Bio-Techniques Press. Westborough, Mass. 298 pp. (ISBN 1-881299-21-X);

MEDICAL APPLICATIONS OF CONTROLLED RELEASE, Langer and Wise (eds.), CRC Pres., Boca Raton, Fla. (1974);

Old, R. W. & S. B. Primrose, PRINCIPLES OF GENE MANIPULATION: AN INTRODUCTION TO GENETIC ENGINEERING (3d Ed. 1985) Blackwell Scientific Publications, Boston. Studies in Microbiology; V.2:409 pp. (ISBN 0-632-01318-4);

Sambrook, J. et al. eds., MOLECULAR CLONING: A LABORATORY MANUAL (2d Ed. 1989) Cold Spring Harbor Laboratory Press, NY. Vols. 1-3. (ISBN 0-87969-309-6);

SUSTAINED AND CONTROLLED RELEASE DRUG DELIVERY SYSTEMS, J. R. Robinson, ed., Marcel Dekker, Inc., New York, 1978;

Winnacker, E. L. FROM GENES TO CLONES: INTRODUCTION TO GENE TECHNOLOGY (1987) VCH Publishers, NY (translated by Horst Ibelgaufts). 634 pp. (ISBN 0-89573-614-4).

The contents of all cited references (including literature references, patents, patent applications, and websites) that maybe cited throughout this application are hereby expressly incorporated by reference in their entirety for any purpose, as are the references cited therein. The disclosure will employ, unless otherwise indicated, conventional techniques of immunology, molecular biology and cell biology, which are well known in the art.

EQUIVALENTS

The disclosure may be embodied in other specific forms without departing from the spirit or essential characteristics thereof. The foregoing embodiments are therefore to be considered in all respects illustrative rather than limiting of the disclosure. Scope of the disclosure is thus indicated by the appended claims rather than by the foregoing description, and all changes that come within the meaning and range of equivalency of the claims are therefore intended to be embraced herein.

SEQUENCE LISTING (824 sequences)

SEQ ID NO: 1 - protein, 16 aa, Artificial Sequence
  Description of Artificial Sequence: Synthetic peptide
AKTTPKLEEGEFSEAR

SEQ ID NO: 2 - protein, 17 aa, Artificial Sequence
  Description of Artificial Sequence: Synthetic peptide
AKTTPKLEEGEFSEARV

SEQ ID NO: 3 - protein, 9 aa, Artificial Sequence
  Description of Artificial Sequence: Synthetic peptide
AKTTPKLGG

SEQ ID NO: 4 - protein, 10 aa, Artificial Sequence
  Description of Artificial Sequence: Synthetic peptide
SAKTTPKLGG

SEQ ID NO: 5 - protein, 6 aa, Artificial Sequence
  Description of Artificial Sequence: Synthetic peptide
SAKTTP

SEQ ID NO: 6 - protein, 6 aa, Artificial Sequence
  Description of Artificial Sequence: Synthetic peptide
RADAAP

SEQ ID NO: 7 - protein, 9 aa, Artificial Sequence
  Description of Artificial Sequence: Synthetic peptide
RADAAPTVS

SEQ ID NO: 8 - protein, 12 aa, Artificial Sequence
  Description of Artificial Sequence: Synthetic peptide
RADAAAAGGPGS

SEQ ID NO: 9 - protein, 27 aa, Artificial Sequence
  Description of Artificial Sequence: Synthetic peptide
RADAAAAGGGGSGGGGSGGGGSGGGGS

SEQ ID NO: 10 - protein, 18 aa, Artificial Sequence
  Description of Artificial Sequence: Synthetic peptide
SAKTTPKLEEGEFSEARV

SEQ ID NO: 11 - protein, 5 aa, Artificial Sequence
  Description of Artificial Sequence: Synthetic peptide
ADAAP

SEQ ID NO: 12 - protein, 12 aa, Artificial Sequence
  Description of Artificial Sequence: Synthetic peptide
ADAAPTVSIFPP

SEQ ID NO: 13 - protein, 5 aa, Artificial Sequence
  Description of Artificial Sequence: Synthetic peptide
TVAAP

SEQ ID NO: 14 - protein, 12 aa, Artificial Sequence
  Description of Artificial Sequence: Synthetic peptide
TVAAPSVFIFPP

SEQ ID NO: 15 - protein, 6 aa, Artificial Sequence
  Description of Artificial Sequence: Synthetic peptide
QPKAAP

SEQ ID NO: 16 - protein, 13 aa, Artificial Sequence
  Description of Artificial Sequence: Synthetic peptide
QPKAAPSVTLFPP

SEQ ID NO: 17 - protein, 6 aa, Artificial Sequence
  Description of Artificial Sequence: Synthetic peptide
AKTTPP

SEQ ID NO: 18 - protein, 13 aa, Artificial Sequence
  Description of Artificial Sequence: Synthetic peptide
AKTTPPSVTPLAP

SEQ ID NO: 19 - protein, 6 aa, Artificial Sequence
  Description of Artificial Sequence: Synthetic peptide
AKTTAP

SEQ ID NO: 20 - protein, 13 aa, Artificial Sequence
  Description of Artificial Sequence: Synthetic peptide
AKTTAPSVYPLAP

SEQ ID NO: 21 - protein, 6 aa, Artificial Sequence
  Description of Artificial Sequence: Synthetic peptide
ASTKGP

SEQ ID NO: 22 - protein, 13 aa, Artificial Sequence
  Description of Artificial Sequence: Synthetic peptide
ASTKGPSVFPLAP

SEQ ID NO: 23 - protein, 15 aa, Artificial Sequence
  Description of Artificial Sequence: Synthetic peptide
GGGGSGGGGSGGGGS

SEQ ID NO: 24 - protein, 15 aa, Artificial Sequence
  Description of Artificial Sequence: Synthetic peptide
GENKVEYAPALMALS

SEQ ID NO: 25 - protein, 15 aa, Artificial Sequence
  Description of Artificial Sequence: Synthetic peptide
GPAKELTPLKEAKVS

SEQ ID NO: 26 - protein, 15 aa, Artificial Sequence
  Description of Artificial Sequence: Synthetic peptide
GHEAAAVMQVQYPAS

SEQ ID NO: 27 - protein, 24 aa, Artificial Sequence
  Description of Artificial Sequence: Synthetic peptide
TVAAPSVFIFPPTVAAPSVFIFPP

SEQ ID NO: 28 - protein, 26 aa, Artificial Sequence
  Description of Artificial Sequence: Synthetic peptide
ASTKGPSVFPLAPASTKGPSVFPLAP

SEQ ID NO: 29 - protein, 5 aa, Artificial Sequence
  Description of Artificial Sequence: Synthetic peptide
GGGGS

SEQ ID NO: 30 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 31 - protein, 108 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 32 - protein, 126 aa, Artificial Sequence
  Description of Artificial Sequence: Synthetic polypeptide
EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 33 - protein, 108 aa, Artificial Sequence
  Description of Artificial Sequence: Synthetic polypeptide
EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 34 - protein, 126 aa, Artificial Sequence
  Description of Artificial Sequence: Synthetic polypeptide
EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 35 - protein, 108 aa, Artificial Sequence
  Description of Artificial Sequence: Synthetic polypeptide
EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 36 - protein, 117 aa, Homo sapiens
EVQLVQSGAEVKKPGASVKVSCKASGYTFTSYDVNWVRQATGQGLEWMGWMNPNSGNTGYAQKFQGRVTITADESTSTAYMELSSLRSEDTAVYYCAIFDSDYMDVWGKGTLVTVSS

SEQ ID NO: 37 - protein, 120 aa, Homo sapiens
EVQLVQSGAEVKKPGSSAKVSCKASGGTFSSYAISWVRQAPGQGLEWMGGIIPILGTANYAQKFLGRVTITADESTSTVYMELSSLRSEDTAVYYCARGLYYDPTRADYWGQGTLVTVSS

SEQ ID NO: 38 - protein, 126 aa, Homo sapiens
EVQLVESGGGLVQPGGSLRLSCATSGFTFNNYWMSWVRQAPGKGLEWVANINHDESEKYYVDSAKGRFTISRDNAEKSLFLQMNSLRAEDTAVYYCARIIRGRVGFDYYNYAMDVWGQGTLVTVSS

SEQ ID NO: 39 - protein, 124 aa, Homo sapiens
EVQLVQSGAEVKKPGASVKVSCKTSGYTFSNYDINWVRQPTGQGLEWMGWMDPNNGNTGYAQKFVGRVTMTRDTSKTTAYLELSGLKSEDTAVYYCARSSGSGGTWYKEYFQSWGQGTMVTVSS

SEQ ID NO: 40 - protein, 115 aa, Homo sapiens
EVQLVQSGAEVKKPGASVKVSCKTSGYSLTQYPIHWVRQAPGQRPEWMGWISPGNGNTKLSPKFQGRVTLSRDASAGTVFMDLSGLTSDDTAVYFCTSVDLGDHWGQGTLVTVSS

SEQ ID NO: 41 - protein, 113 aa, Homo sapiens
EVQLVESGGGLVQPGRSLRLSCAASGFTFDDYPMHWVRQAPGEGLEWVSGISSNSASIGYADSVKGRFTISRDNAQNTLYLQMNSLGDEDTAVYYCVSLTLGIGQGTLVTVSS

SEQ ID NO: 42 - protein, 108 aa, Homo sapiens
SYELTQPPSVSLSPGQTARITCSGDALPKQYAYWYQQKPGQAPVLVIYKDTERPSGIPERFSGSSSGTTVTLTISGAQAEDEADYYCQSADSSGTSWVFGGGTKLTVL

SEQ ID NO: 43 - protein, 108 aa, Homo sapiens
DIVMTQSPDFHSVTPKEKVTITCRASQSIGSSLHWYQQKPDQSPKLLIRHASQSISGVPSRFSGSGSGTDFTLTIHSLEAEDAATYYCHQSSSSPPPTFGQGTQVEIK

SEQ ID NO: 44 - protein, 105 aa, Homo sapiens
DIRLTQSPSPLSASVGDRVTITCRASQSIGNYLNWYQHKPGKAPKLLIYAASSLQSGVPSRFSGTGSGTDFTLTISSLQPEDFATYYCQESYSLIFAGGTKVEIK

SEQ ID NO: 45 - protein, 113 aa, Homo sapiens
DIVMTQSPLSLPVTPGEPASISCRSSQSLLHSNGYNYLDWYLQKPGQFPQLLIYLGSYRASGVPDRFSGSGSGTDFTLKISRVEAEDVGVYYCMQRIEFPPGTFGQGTKLGIK

SEQ ID NO: 46 - protein, 107 aa, Homo sapiens
DIVMTQSPEFQSVTPKEKVTITCRASQSIGSSLHWYQQKPDQSPKLLINYASQSFSGVPSRFSGGGSGTDFTLTINSLEAEDAATYYCHQSSNLPITFGQGTRLEIK

SEQ ID NO: 47 - protein, 107 aa, Homo sapiens
DIRLTQSPSSLSASVGDRVTITCRASQSIGNYLHWYQQKPGKAPKLLIYAASSLQSGVPSRFSGSGSGTDFTLTISSLQPEDFATYYCQQSYSTLYSFGQGTKLEIK

SEQ ID NO: 48 - protein, 117 aa, Artificial Sequence
  Description of Artificial Sequence: Synthetic polypeptide
EVQLVESGGGLVQPGGSLRLSCAASGFTFSNYGVNWVRQAPGKGLEWVSMIAADGFTDYASSVKGRFTISRDNSKNTLYLQMNSLRAEDTAVYYCAREWHHGPVAYWGQGTLVTVSS

SEQ ID NO: 49 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSLIRGDGSTDYASSLKGRFTISRDNSKNTLYLQMNSLRAEDTAVYYCAREWHHGPVAYWGQGTLVTVSS

SEQ ID NO: 50 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIWADGSTHYADTLKSRFTISRDNSKNTLYLQMNSLRAEDTAVYYCAREWQHGPVAYWGQGTLVTVSS

SEQ ID NO: 51 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTDYADTVKGRFTISRDNSKNTLYLQMNSLRAEDTAVYYCAREWQHGPVAYWGQGTLVTVSS

SEQ ID NO: 52 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYADSVKSRFTISRDNSKNTLYLQMNSLRAEDTAVYYCAREWQHGPLAYWGQGTLVTVSS

SEQ ID NO: 53 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWSDGSTDYASSVKGRFTISRDNSKNTLYLQMNSLRAEDTAVYYCAREWQHGPVAYWGQGTLVTVSS

SEQ ID NO: 54 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSLKGRFTISRDNSKNTLYLQMNSLRAEDTAVYYCAREWQHGPAAYWGQGTLVTVSS

SEQ ID NO: 55 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIWADGSTHYASSLKGRFTISRDNSKNTLYLQMNSLRAEDTAVYYCAREWQHGPVAYWGQGTLVTVSS

SEQ ID NO: 56 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPAAYWGQGTLVTVSS

SEQ ID NO: 57 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPSAYWGQGTLVTVSS

SEQ ID NO: 58 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS

SEQ ID NO: 59 - protein, 117 aa, Artificial Sequence
  Description of Artificial Sequence: Synthetic polypeptide
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS

SEQ ID NO: 60 - protein, 117 aa, Artificial Sequence
  Description of Artificial Sequence: Synthetic polypeptide
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVGYWGQGTLVTVSS

SEQ ID NO: 61 - protein, 117 aa, Artificial Sequence; identical to SEQ ID NO: 60
  Description of Artificial Sequence: Synthetic polypeptide

SEQ ID NO: 62 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTDYASTVKGRFTISRDNSKNTLYLQMNSLRAEDTAVYYCAREWQHGPVGYWGQGTLVTVSS

SEQ ID NO: 63 - protein, 117 aa, Artificial Sequence; identical to SEQ ID NO: 58
  Description of Artificial Sequence: Synthetic polypeptide

SEQ ID NO: 64 - protein, 117 aa, Artificial Sequence; identical to SEQ ID NO: 52
  Description of Artificial Sequence: Synthetic polypeptide

SEQ ID NO: 65 - protein, 117 aa, Artificial Sequence
  Description of Artificial Sequence: Synthetic polypeptide
EVQLVESGGGLVQPGGSLRLSCAASGFTFSNYGVQWVRQAPGKGLEWVSGIGADGSTAYASSLKGRFTISRDNSKNTLYLQMNSLRAEDTAVYYCAREWQHSGLAYWGQGTLVTVSS

SEQ ID NO: 66 - protein, 117 aa, Artificial Sequence
  Description of Artificial Sequence: Synthetic polypeptide
EVQLVESGGGLVQPGGSLRLSCAASGFTFSNYGVSWVRQAPGKGLEWVSMIWADGSTHYADTVKGRFTISRDNSKNTLYLQMNSLRAEDTAVYYCAREWQHGPLAYWGQGTLVTVSS

SEQ ID NO: 67 - protein, 117 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYADTVKGRFTISRDNSKNTLYLQMNSLRAEDTAVYYCAREWQHGPLAYWGQGTLVTVSS

SEQ ID NO: 68 - protein, 117 aa, Artificial Sequence; identical to SEQ ID NO: 58
  Description of Artificial Sequence: Synthetic polypeptide

SEQ ID NO: 69 - protein, 117 aa, Artificial Sequence; identical to SEQ ID NO: 58
  Description of Artificial Sequence: Synthetic polypeptide

SEQ ID NO: 70 - protein, 117 aa, Artificial Sequence; identical to SEQ ID NO: 58
  Description of Artificial Sequence: Synthetic polypeptide

SEQ ID NO: 71 - protein, 117 aa, Artificial Sequence; identical to SEQ ID NO: 58
  Description of Artificial Sequence: Synthetic polypeptide

SEQ ID NO: 72 - protein, 117 aa, Artificial Sequence; identical to SEQ ID NO: 58
  Description of Artificial Sequence: Synthetic polypeptide

SEQ ID NO: 73 - protein, 108 aa, Artificial Sequence
  Description of Artificial Sequence: Synthetic polypeptide
DIQMTQSPSSLSASVGDRVTITCKASQAVSSAVAWYQQKPGKAPKLLIYWASTRHTGVPSRFSGSGSGTDFTLTISSLQPEDFATYYCQQHYSTPFTFGQGTKLEIKR

SEQ ID NO: 74 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASTLHTGVPSRFSGSGSGTDFTLTISSLQPEDFATYYCQQHYRTPFTFGQGTKLEIKR

SEQ ID NO: 75 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASTRHSGVPSRFSGSGSGTDFTLTISSLQPEDFATYYCQQHYRTPFSFGQGTKLEIKR

SEQ ID NO: 76 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASTRHSGVPSRFSGSGSGTDFTLTISSLQPEDFATYYCQQHYRTPFTFGQGTKLEIKR

SEQ ID NO: 77 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFSFGQGTKLEIKR

SEQ ID NO: 78 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR

SEQ ID NO: 79 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASARHTGVPSRFSGSGSGTDFTLTISSLQPEDFATYYCQQHYRTPFTFGQGTKLEIKR

SEQ ID NO: 80 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASTRHTGVPSRFSGSGSGTDFTLTISSLQPEDFATYYCQQHYRTPFTFGQGTKLEIKR

SEQ ID NO: 81 - protein, 108 aa, Artificial Sequence
  Description of Artificial Sequence: Synthetic polypeptide
DIQMTQSPSSLSASVGDRVTITCRASQGVSSALAWYQQKPGKAPKLLIYWASALHSGVPSRFSGSGSGTDFTLTISSLQPEDFATYYCQQHYSAPFTFGQGTKLEIKR

SEQ ID NO: 82 - protein, 108 aa, Artificial Sequence
  Description of Artificial Sequence: Synthetic polypeptide
DIQMTQSPSSLSASVGDRVTITCRASQLVSSAVAWYQQKPGKAPKLLIYWASTLHSGVPSRFSGSGSGTDFTLTISSLQPEDFATYYCQQHYSTPFTFGQGTKLEIKR

SEQ ID NO: 83 - protein, 108 aa, Artificial Sequence
  Description of Artificial Sequence: Synthetic polypeptide
DIQMTQSPSSLSASVGDRVTITCKASQLVSSAVAWYQQKPGKAPKLLIYWASTRHTGVPSRFSGSGSGTDFTLTISSLQPEDFATYYCQQHYSTPFTFGQGTKLEIKR

SEQ ID NO: 84 - protein, 108 aa, Artificial Sequence
  Description of Artificial Sequence: Synthetic polypeptide
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKR

SEQ ID NO: 85 - protein, 108 aa, Artificial Sequence
  Description of Artificial Sequence: Synthetic polypeptide
DIQMTQSPSSLSASVGDRVTITCKASQKVSSALAWYQQKPGKAPKLLIYWASALHSGVPSRFSGSGSGTDFTLTISSLQPEDFATYYCQQHYRPPFTFGQGTKLEIKR

SEQ ID NO: 86 - protein, 108 aa, Artificial Sequence
  Description of Artificial Sequence: Synthetic polypeptide
DIQMTQSPSSLSASVGDRVTITCKASQLVSSAVAWYQQKPGKAPKLLIYWASALHTGVPSRFSGSGSGTDFTLTISSLQPEDFATYYCQQHYSSPYTFGQGTKLEIKR

SEQ ID NO: 87 - protein, 108 aa, Artificial Sequence; identical to SEQ ID NO: 84
  Description of Artificial Sequence: Synthetic polypeptide

SEQ ID NO: 88 - protein, 124 aa, Artificial Sequence
  Description of Artificial Sequence: Synthetic polypeptide
EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSS

SEQ ID NO: 89 - protein, 124 aa, Artificial Sequence
  Description of Artificial Sequence: Synthetic polypeptide
EVQLVQSGAEVKKPGASVKVSCKASGYTFNNYGIIWVRQAPGQGLEWMGWINTYTGKPTYAQKLQGRVTMTTDTSTSTAYMELSSLRSEDTAVYFCARKLFNTVDVTDNAMDYWGQGTTVTVSS

SEQ ID NO: 90 - protein, 124 aa, Artificial Sequence
  Description of Artificial Sequence: Synthetic polypeptide
EVQLVQSGAEVKKPGASVKVSCKASGYTFNNYGIIWVRQAPGQGLEWMGWINTYTGVPTYAQKFQGRVTMTTDTSTSTAYMELSSLRSEDTAVYYCARKLFNTVDVTDNAMDYWGQGTTVTVSS

SEQ ID NO: 91 - protein, 124 aa, Artificial Sequence
  Description of Artificial Sequence: Synthetic polypeptide
EVQLVQSGAEVKKPGASVKVSCKASGYTFNNYGIIWVRQAPGQGLEWMGWINTYTGKPTYAQKFQGRVTMTTDTSTSTAYMELSSLRSEDTAVYYCARKLFNTVAVTDNAMDYWGQGTTVTVSS

SEQ ID NO: 92 - protein, 124 aa, Artificial Sequence
  Description of Artificial Sequence: Synthetic polypeptide
EVQLVQSGAEVKKPGASVKVSCKASGYTFRNYGIIWVRQAPGQGLEWMGWINTYTGKPTYAQKFQGRVTMTTDTSTSTAYMELSSLRSEDTAVYFCARKLFTTVDVTDNAMDYWGQGTTVTVSS

SEQ ID NO: 93 - protein, 124 aa, Artificial Sequence
  Description of Artificial Sequence: Synthetic polypeptide
EVQLVQSGAEVKKPGASVKVSCKASGYTFNNYGINWVRQAPGQGLEWMGWINTYTGKPTYAQKFQGRVTMTTDTSTSTAYMELSSLRSEDTAVYFCARKFRNTVAVTDYAMDYWGQGTTVTVSS

SEQ ID NO: 94 - protein, 124 aa, Artificial Sequence
  Description of Artificial Sequence: Synthetic polypeptide
EVQLVQSGAEVKKPGASVKVSCKASGYTFRNYGITWVRQAPGQGLEWMGWINTYTGKPTYAQKFQGRVTMTTDTSTSTAYMELSSLRSEDTAVYFCARKLFTTMDVTDNAMDYWGQGTTVTVSS

SEQ ID NO: 95 - protein, 124 aa, Artificial Sequence; identical to SEQ ID NO: 88
  Description of Artificial Sequence: Synthetic polypeptide

SEQ ID NO: 96 - protein, 124 aa, Artificial Sequence
  Description of Artificial Sequence: Synthetic polypeptide
EVQLVQSGAEVKKPGASVKVSCKASGYTFSNYGINWVRQAPGQGLEWMGWINTYTGQPSYAQKFQGRVTMTTDTSTSTAYMELSSLRSEDTAVYYCARKLFKTEAVTDYAMDYWGQGTTVTVSS

SEQ ID NO: 97 - protein, 124 aa, Artificial Sequence
  Description of Artificial Sequence: Synthetic polypeptide
EVQLVQSGAEVKKPGASVKVSCKASGYTFNNYGIIWVRQAPGQGLEWMGWINTYSGKPTYAQKFQGRVTMTTDTSTSTAYMELSSLRSEDTAVYFCARKLFTTMDVTDNAMDYWGQGTTVTVSS

SEQ ID NO: 98 - protein, 107 aa, Artificial Sequence
  Description of Artificial Sequence: Synthetic polypeptide
DIQMTQSPSSLSASVGDRVTITCRASQDISQYLNWYQQKPGKAPKLLIYYTSRLQSGVPSRFSGSGSGTDFTLTISSLQPEDFATYFCQQGNTWPPTFGQGTKLEIK

SEQ ID NO: 99 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNSWPPTFGQGTKLEIK

SEQ ID NO: 100 - protein, 107 aa, Artificial Sequence
  Description of Artificial Sequence: Synthetic polypeptide
DIQMTQSPSSLSASVGDRVTITCRASQDIYNYLNWYQQKPGKAPKLLIYYTSRLQSGVPSRFSGSGSGTDYTLTISSLQPEDFATYFCQQGNTQPPTFGQGTKLEIK

SEQ ID NO: 101 - protein, 107 aa, Artificial Sequence
  Description of Artificial Sequence: Synthetic polypeptide
DIQMTQSPSSLSASVGDRVTITCRASQDIENYLNWYQQKPGKAPKLLIYYTSRLQSGVPSRFSGSGSGTDFTLTISSLQPEDFATYFCQQGNTQPPTFGQGTKLEIK

SEQ ID NO: 102 - protein, 107 aa, Artificial Sequence
  Description of Artificial Sequence: Synthetic polypeptide
DIQMTQSPSSLSASVGDRVTITCRASQDISNYLNWYQQKPGKAPKLLIYYTSRLQSGVPSRFSGSGSGTDYTLTISSLQPEDFATYFCQQGNTWPPTFGQGTKLEIK

SEQ ID NO: 103 - protein, 107 aa, Artificial Sequence
  Description of Artificial Sequence: Synthetic polypeptide
DIQMTQSPSSLSASVGDRVTITCRASQDIYDVLNWYQQKPGKAPKLLIYYASRLQSGVPSRFSGSGSGTDFTLTISSLQPEDFATYYCQQGITLPPTFGQGTKLEIK

SEQ ID NO: 104 - protein, 107 aa, Artificial Sequence; identical to SEQ ID NO: 102
  Description of Artificial Sequence: Synthetic polypeptide

SEQ ID NO: 105 - protein, 107 aa, Artificial Sequence; identical to SEQ ID NO: 98
  Description of Artificial Sequence: Synthetic polypeptide

SEQ ID NO: 106 - protein, 107 aa, Artificial Sequence
  Description of Artificial Sequence: Synthetic polypeptide
DIQMTQSPSSLSASVGDRVTITCRASQNIYNVLNWYQQKPGKAPKLLIYYASRLQSGVPSRFSGSGSGTDFTLTISSLQPEDFATYFCQQGNTMPPTFGQGTKLEIK

SEQ ID NO: 107 - protein, 107 aa, Artificial Sequence
  Description of Artificial Sequence: Synthetic polypeptide
DIQMTQSPSSLSASVGDRVTITCRASQDISNFLNWYQQKPGKAPKLLIYYTSRLQSGVPSRFSGSGSGTDYTLTISSLQPEDFATYFCQQGNTQPPTFGQGTKLEIK

SEQ ID NO: 108 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYRYESFYGMDYWGQGTTVTVSS

SEQ ID NO: 109 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWDSFYGMDYWGQGTTVTVSS

SEQ ID NO: 110 - protein, 121 aa, Artificial Sequence; identical to SEQ ID NO: 30
  Description of Artificial Sequence: Synthetic polypeptide

SEQ ID NO: 111 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYDKWYSFEGMDIWGQGTTVTVSS

SEQ ID NO: 112 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRVTLSADESTSTAYMELSSLRSEDTAVYYCTRYDKYWSFEGMDYWGQGTTVTVSS

SEQ ID NO: 113 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWYSFEGMDIWGQGTTVTVSS

SEQ ID NO: 114 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKYWSFEGMDYWGQGTTVTVSS

SEQ ID NO: 115 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKWYSFEGMDIWGQGTTVTVSS

SEQ ID NO: 116 - protein, 107 aa, Artificial Sequence
  Description of Artificial Sequence: Synthetic polypeptide
DIQMTQSPSSLSASVGDRVTITCSASSGSISYIDWFQQKPGKAPKRLIYATFELASGVPSRFSGSGSGTDFTLTISSLQPEDFATYYCHQLGSYPDTFGQGTKLEIK

SEQ ID NO: 117 - protein, 107 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIK

SEQ ID NO: 118 - protein, 107 aa, Artificial Sequence
  Description of Artificial Sequence: Synthetic polypeptide
DIQMTQSPSSLSASVGDRVTITCSASSGIISSIDWFQQKPGKAPKRLIYATFALQSGVPSRFSGSGSGTDFTLTISSLQPEDFATYYCSQMSSYPHTFGQGTKLEIK

SEQ ID NO: 119 - protein, 107 aa, Artificial Sequence
  Description of Artificial Sequence: Synthetic polypeptide
DIQMTQSPSSLSASVGDRVTITCSASSDISSYLNWFQQKPGKSPKRLIYRTSELQSGVPSRFSGSGSGTDFTLTISSLQPEDFATYYCQQWSSYPWTFGQGTKLEIK

SEQ ID NO: 120 - protein, 107 aa, Artificial Sequence
  Description of Artificial Sequence: Synthetic polypeptide
DIQMTQSPSSLSASVGDRVTITCSASQGIRSYIDWFQQKPGKSPKRLIYATFDLASGVPSRFSGSGSGTDYTLTISSLQPEDFATYYCRQVGNYPGTFGQGTKLEIK

SEQ ID NO: 121 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPDSGGTFYNQKFDGRVTITADKSTSTAYMELSSLRSEDTAVYYCTRYYRYESFYGMDYWGQGTTVTVSS

SEQ ID NO: 122 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVIDPESGGTLYNQKFDGRVTLTADKSTSTAYMELSSLRSEDTAVYYCTRYYRYESFYGMDYWGQGTTVTVSS

SEQ ID NO: 123 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPDSGGTLYNQKFDGRVTLTADKSTSTAYMELSSLRSEDTAVYYCTRYYRYESFYGMDYWGQGTTVTVSS

SEQ ID NO: 124 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPDSGGTLYNQKFDGRVTITADESTSTAYMELSSLRSEDTAVYYCTRYYRYESFYGMDYWGQGTTVTVSS

SEQ ID NO: 125 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTMYNQKFDGRVTITADKSTSTAYMELSSLRSEDTAVYYCTRYYRYESFYGMDYWGQGTTVTVSS

SEQ ID NO: 126 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYYRYESFYGMDYWGQGTTVTVSS

SEQ ID NO: 127 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTLYNQKFDGRVTLTADKSTSTAYMELSSLRSEDTAVYYCTRYYRYESFYGMDYWGQGTTVTVSS

SEQ ID NO: 128 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADESTSTAYMELSSLRSEDTAVYYCTRYYRYESFYGMDYWGQGTTVTVSS

SEQ ID NO: 129 - protein, 121 aa, Artificial Sequence; identical to SEQ ID NO: 108
  Description of Artificial Sequence: Synthetic polypeptide

SEQ ID NO: 130 - protein, 121 aa, Artificial Sequence
  Description of Artificial Sequence: Synthetic polypeptide
EVQLVQSGAEVRKPGSSVKVSCKASGYTFEDYEIHWVRQAPGQGLEWMGVIDPESGGTLYNQKFDGRVTLTADKSTSTAYMELSSLRSEDTAVYYCTRYYRYESFYGMDYWGQGTTVTVSS

SEQ ID NO: 131 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTLYNQKFDGRVTLTADESTSTAYMELSSLRSEDTAVYYCTRYYRYESFYGMDYWGQGTTVTVSS

SEQ ID NO: 132 - protein, 121 aa, Artificial Sequence; identical to SEQ ID NO: 122
  Description of Artificial Sequence: Synthetic polypeptide

SEQ ID NO: 133 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVIDPESGGTLYNQKFDGRATLTADKSTSTAYMELSSLRSEDTAVYYCTRYYRYESFYGMDYWGQGTTVTVSS

SEQ ID NO: 134 - protein, 121 aa, Artificial Sequence
  Description of Artificial Sequence: Synthetic polypeptide
EVQLVQSGAEVKKPGSSVKVSCKASGYTFEDYEIHWVRQAPGQGLEWMGVIDPESGGTLYNQKFDGRVTLTADKSTSTAYMELSSLRSEDTAVYYCTRYYRYESFYGMDYWGQGTTVTVSS

SEQ ID NO: 135 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPESGGTLYNQKFDGRVTITADKSTSTAYMELSSLRSEDTAVYYCTRYYRYESFYGMDYWGQGTTVTVSS

SEQ ID NO: 136 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTLYNQKFDGRVTLTADKSTSTAYMELSSLRSEDTAVYYCTRYYRYESFHGMDYWGQGTTVTVSS

SEQ ID NO: 137 - protein, 121 aa, Artificial Sequence
  Description of Artificial Sequence: Synthetic polypeptide
EVQLVQSGAEVKKPGSSVKVSCKASGYTFADYEIHWVRQAPGQGLEWIGVNDPESGGTFYNQKFDGRATLTADKSTSTAYMELSSLRSEDTAVYYCTRYYRYESFYGMDYWGQGTTVTVSS

SEQ ID NO: 138 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPDSGGTLYNQKFDGRVTITADKSTSTAYMELSSLRSEDTAVYYCTRYYRYESFYGMDYWGQGTTVTVSS

SEQ ID NO: 139 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWIGVNDPESGGTLYNQKFDGRVTITADKSTSTAYMELSSLRSEDTAVYYCTRYYRYESFYGMDYWGQGTTVTVSS

SEQ ID NO: 140 - protein, 121 aa, Artificial Sequence
  Description of Artificial Sequence: Synthetic polypeptide
EVQLVQSGAEVKKPGSSVKVSCKASGYTFEDYEIHWVRQAPGQGLEWMGVIDPESGGTLYNQKFDGRATITADKSTSTAYMELSSLRSEDTAVYYCTRYYRYESFYGMDYWGQGTTVTVSS

SEQ ID NO: 141 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTLYNQKFDGRVTITADKSTSTAYMELSSLRSEDTAVYYCTKYYRYESFYGMDYWGQGTTVTVSS

SEQ ID NO: 142 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVIDPESGGTLYNQKFDGRATITADESTSTAYMELSSLRSEDTAVYYCTRYYRYESFYGMDYWGQGTTVTVSS

SEQ ID NO: 143 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTLYNQKFDGRATITADKSTSTAYMELSSLRSEDTAVYYCTRYYRYESFYGMDYWGQGTTVTVSS

SEQ ID NO: 144 - protein, 121 aa, Artificial Sequence
  Description of Artificial Sequence: Synthetic polypeptide
EVQLVQSGAEVKKPGSSVKVSCKASGYTFTEYEIHWVRQAPGQGLEWMGVNDPESGGSFYNQKFDGRVTLTADKSTSTAYMELSSLRSEDTAVYYCTRYYRYESFYGMDYWGQGTTVTVSS

SEQ ID NO: 145 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRVTLTADKSTSTAYMELSSLRSEDTAVYYCTRYYRYESFYGMDYWGQGTTVTVSS

SEQ ID NO: 146 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVIDPESGGSLYNQKFDGRVTITADKSTSTAYMELSSLRSEDTAVYYCTRYYRYESFYGMDYWGQGTTVTVSS

SEQ ID NO: 147 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVIDPESGGTLYNQKFDGRATITADKSTSTAYMELSSLRSEDTAVYYCTRYYRYESFYGMDYWGQGTTVTVSS

SEQ ID NO: 148 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTLYNQKFDGRATLTADKSTSTAYMELSSLRSEDTAVYYCTRYYRYESFYGMDYWGQGTTVTVSS

SEQ ID NO: 149 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVIDPESGGSLYNQKFDGRVTLTADKSTSTAYMELSSLRSEDTAVYYCTRYYRYESFYGMDYWGQGTTVTVSS

SEQ ID NO: 150 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPDSGGTLYNQKFDGRVTITADKSTSTAYMELSSLRSEDTAVYYCTRYYRYESFYGMDYWGQGTTVTVSS

SEQ ID NO: 151 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGILYNQKFDGRATLTADKSTSTAYMELSSLRSEDTAVYYCTRYYRYESFYGMDYWGQGTTVTVSS

SEQ ID NO: 152 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYYRYESFYGMDYWGQGTTVTVSS

SEQ ID NO: 153 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTLYNQKFDGRVTITADKSTSTAYMELSSLRSEDTAVYYCTRYYRYESFYGMDYWGQGTTVTVSS

SEQ ID NO: 154 - protein, 121 aa, Artificial Sequence
  Description of Artificial Sequence: Synthetic polypeptide
EVQLVQSGAEVKKPGSSVKVSCKASGYTFDEYEIHWVRQAPGQGLEWMGVIDPESGGTLYNQKFDGRVTLTADKSTSTAYMELSSLRSEDTAVYYCTRYYRYESFYGMDYWGQGTTVTVSS

SEQ ID NO: 155 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTLYNQKFDGRVTLTADKSTSTAYMELSSLRSEDTAVYYCTRYYRYESFYGMDYWGQGTTVTVSS

SEQ ID NO: 156 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVIDPESGGTLYNQKFDGRVTLTADKSTSTAYMELSSLRSEDTAVYYCTRYYRYESFYGMDYWGQGTTVTVSS

SEQ ID NO: 157 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTLYNQKFDGRATITADKSTSTAYMELSSLRSEDTAVYYCTRYYRYESFYGMDYWGQGTTVTVSS

SEQ ID NO: 158 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVIDPESGGSFYNQKFDGRATLTADKSTSTAYMELSSLRSEDTAVYYCTRYYRYESFYGMDYWGQGTTVTVSS

SEQ ID NO: 159 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTLYNQKFDGRATITADKSTSTAYMELSSLRSEDTAVYYCTRYYRYESFYGMDYWGQGTTVTVSS

SEQ ID NO: 160 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTLYNQKFDGRVTLTTDKSTSTAYMELSSLRSEDTAVYYCTRYYRYESFYGMDYWGQGTTVTVSS

SEQ ID NO: 161 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWYSFYGMDYWGQGTTVTVSS

SEQ ID NO: 162 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYSKYWSFSGMDYWGQGTTVTVSS

SEQ ID NO: 163 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYFGFSGMDFWGQGTTVTVSS

SEQ ID NO: 164 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKFDSFQGMDYWGQGTTVTVSS

SEQ ID NO: 165 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYEGFLGMDYWGQGTTVTVSS

SEQ ID NO: 166 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYWSFYGMDYWGQGTTVTVSS

SEQ ID NO: 167 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKFESFNGMDYWGQGTTVTVSS

SEQ ID NO: 168 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYESFSGMDYWGQGTTVTVSS

SEQ ID NO: 169 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWEGFYGMDYWGQGTTVTVSS

SEQ ID NO: 170 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWESFYGMDFWGQGTTVTVSS

SEQ ID NO: 171 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWDGFNGMDYWGQGTTVTVSS

SEQ ID NO: 172 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWDSFYGMDYWGQGTTVTVSS

SEQ ID NO: 173 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYESFYGMDYWGQGTTVTVSS

SEQ ID NO: 174 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDRYWSFNGMDYWGQGTTVTVSS

SEQ ID NO: 175 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYKWDSFLGMDFWGQGTTVTVSS

SEQ ID NO: 176 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDMWESFNGMDYWGQGTTVTVSS

SEQ ID NO: 177 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYKWWGFMGMDYWGQGTTVTVSS

SEQ ID NO: 178 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYRYWGFEGMDYWGQGTTVTVSS

SEQ ID NO: 179 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYWSFQGMDYWGQGTTVTVSS

SEQ ID NO: 180 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYESFEGMDYWGQGTTVTVSS

SEQ ID NO: 181 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWMSFSGMDYWGQGTTVTVSS

SEQ ID NO: 182 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKFYGFNGMDYWGQGTTVTVSS

SEQ ID NO: 183 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYKWDSFYGMDAWGQGTTVTVSS

SEQ ID NO: 184 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYSKWDSFSGMDYWGQGTTVTVSS

SEQ ID NO: 185 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWESFYGMDYWGQGTTVTVSS

SEQ ID NO: 186 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWWSFSGMDYWGQGTTVTVSS

SEQ ID NO: 187 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWESFAGMDYWGQGTTVTVSS

SEQ ID NO: 188 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYRWESFQGMDYWGQGTTVTVSS

SEQ ID NO: 189 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYESLNGMDYWGQGTTVTVSS

SEQ ID NO: 190 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYWKWDSFFGMDYWGQGTTVTVSS

SEQ ID NO: 191 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWESFSGMDYWGQGTTVTVSS

SEQ ID NO: 192 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYVGFEGMDYWGQGTTVTVSS

SEQ ID NO: 193 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKFWSFNGMDYWGQGTTVTVSS

SEQ ID NO: 194 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYSKWDSFQGMDYWGQGTTVTVSS

SEQ ID NO: 195 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYFKWDSFEGMDYWGQGTTVTVSS

SEQ ID NO: 196 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYSKWNSFDGMDYWGQGTTVTVSS

SEQ ID NO: 197 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYSKWDSFDGMDYWGQGTTVTVSS

SEQ ID NO: 198 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWESFNGMDYWGQGTTVTVSS

SEQ ID NO: 199 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYWKWDSFYGMDSWGQGTTVTVSS

SEQ ID NO: 200 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKFDSFYGMDYWGQGTTVTVSS

SEQ ID NO: 201 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWEGFRGMDLWGQGTTVTVSS

SEQ ID NO: 202 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYEKWDSFNGMDYWGQGTTVTVSS

SEQ ID NO: 203 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYKWESFQGMDYWGQGTTVTVSS

SEQ ID NO: 204 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKFYSFNGMDYWGQGTTVTVSS

SEQ ID NO: 205 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYNKWDSFLGMDYWGQGTTVTVSS

SEQ ID NO: 206 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKYESFNGMDYWGQGTTVTVSS

SEQ ID NO: 207 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYRYESFYGMDYWGKGTTVTVSS

SEQ ID NO: 208 - protein, 121 aa, Artificial Sequence; identical to SEQ ID NO: 108
  Description of Artificial Sequence: Synthetic polypeptide

SEQ ID NO: 209 - protein, 121 aa, Artificial Sequence; identical to SEQ ID NO: 108
  Description of Artificial Sequence: Synthetic polypeptide

SEQ ID NO: 210 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTLYNQKFDGRVTLTADESTSTAYMELSSLRSEDTAVYYCTRYDRYWSFNGMDYWGQGTTVTVSS

SEQ ID NO: 211 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYWKWDSFFGMDYWGQGTTVTVSS

SEQ ID NO: 212 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRVTLTADKSTSTAYMELSSLRSEDTAVYYCTRYDKWYSFEGMDIWGQGTTVTVSS

SEQ ID NO: 213 - protein, 121 aa, Artificial Sequence
  Description of Artificial Sequence: Synthetic polypeptide
EVQLVQSGAEVKKPGSSVKVSCKASGYTFPDYEIHWVRQAPGQGLEWIGVNDPESGGTFYNQKFDGRATLTADESTSTAYMELSSLRSEDTAVYYCTRYDKWESFNGMDYWGQGTTVTVSS

SEQ ID NO: 214 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTYYNQKFDGRATLTADESTSTAYMELSSLRSEDTAVYYCTRYSKWDSFQGMDYWGQGTTVTVSS

SEQ ID NO: 215 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRATLTADESTSTAYMELSSLRSEDTAVYYCTRYSKWDSFLGMDYWGQGTTVTVSS

SEQ ID NO: 216 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKYWSFQGMDYWGQGTTVTVSS

SEQ ID NO: 217 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKYWSFEGMDYWGQGTTVTVSS

SEQ ID NO: 218 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWIGVNDPESGGTFYNQKFDGRATLTADESTSTAYMELSSLRSEDTAVYYCTRYDKWYSFEGMDIWGQGTTVTVSS

SEQ ID NO: 219 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPESGGTFYNQKFDGRVTLTADKSTSTAYMELSSLRSEDTAVYYCTRYDKWESFNGMDEWGQGTTVTVSS

SEQ ID NO: 220 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKWDSFYGMDYWGQGTTVTVSS

SEQ ID NO: 221 - protein, 121 aa, Artificial Sequence
  Description of Artificial Sequence: Synthetic polypeptide
EVQLVQSGAEVKKPGSSVKVSCKASGYTFNDYEIHWVRQAPGQGLEWIGVNDPESGGTYYNQKFDGRATLTADESTSTAYMELSSLRSEDTAVYYCTRYDKWYSFEGMDIWGQGTTVTVSS

SEQ ID NO: 222 - protein, 121 aa, Artificial Sequence; identical to SEQ ID NO: 112
  Description of Artificial Sequence: Synthetic polypeptide

SEQ ID NO: 223 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPESGGTFYNQKFDGRVTLTADKSTSTAYMELSSLRSEDTAVYYCTRYDKWESFNGMDYWGQGTTVTVSS

SEQ ID NO: 224 - protein, 121 aa, Artificial Sequence; identical to SEQ ID NO: 111
  Description of Artificial Sequence: Synthetic polypeptide

SEQ ID NO: 225 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRATLTADESTSTAYMELSSLRSEDTAVYYCTRYDKYWSFEGMDYWGQGTTVTVSS

SEQ ID NO: 226 - protein, 121 aa, Artificial Sequence
  Description of Artificial Sequence: Synthetic polypeptide
EVQLVQSGAEVKKPGSSVKVSCKASGYTFADYEIHWVRQAPGQGLEWIGVNDPESGGTFYNQKFDGRVTLTADESTSTAYMELSSLRSEDTAVYYCTRYDKYWSFEGMDYWGQGTTVTVSS

SEQ ID NO: 227 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPESGGTFYNQKFDGRVTLTADESTSTAYMELSSLRSEDTAVYYCTRYEKWDSFNGMDYWGQGTTVTVSS

SEQ ID NO: 228 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRITLTADESTSTAYMELSSLRSEDTAVYYCTRYDKWYSFEGMDIWGQGTTVTVSS

SEQ ID NO: 229 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPESGGTFYNQKFDGRVTLTADESTSTAYMELSSLRSEDTAVYYCTRYDKYWSLNGMDEWGQGTTVTVSS

SEQ ID NO: 230 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYDRYWSFNGMDYWGQGTTVTVSS

SEQ ID NO: 231 - protein, 121 aa, Artificial Sequence; identical to SEQ ID NO: 114
  Description of Artificial Sequence: Synthetic polypeptide

SEQ ID NO: 232 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKYWSFNGMDYWGQGTTVTVSS

SEQ ID NO: 233 - protein, 121 aa, Artificial Sequence
  Description of Artificial Sequence: Synthetic polypeptide
EVQLVQSGAEVKKPGSSVKVSCKASGYTFPDYEIHWVRQAPGQGLEWIGVNDPESGGTFYNQKFDGRVTLTADESTSTAYMELSSLRSEDTAVYYCTRYDKWYSFEGMDIWGQGTTVTVSS

SEQ ID NO: 234 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKWYSFEGMDIWGQGTTVTVSS

SEQ ID NO: 235 - protein, 121 aa, Artificial Sequence
  Description of Artificial Sequence: Synthetic polypeptide
EVQLVQSGAEVKKPGSSVKVSCKASGYTFEDYEIHWVRQAPGQGLEWIGVNDPDSGGTLYNQKFDGRVTLTADKSTSTAYMELSSLRSEDTAVYYCTRYSKWDSFLGMDYWGQGTTVTVSS

SEQ ID NO: 236 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKWESFNGMDYWGQGTTVTVSS

SEQ ID NO: 237 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADESTSTAYMELSSLRSEDTAVYYCTRYDKWYSFEGMDIWGQGTTVTVSS

SEQ ID NO: 238 - protein, 121 aa, Artificial Sequence
  Description of Artificial Sequence: Synthetic polypeptide
EVQLVQSGAEVKKPGSSVKVSCKASGYTFADYEIHWVRQAPGQGLEWIGVNDPESGGTFYNQKFDGRATLTADESTSTAYMELSSLRSEDTAVYYCTRYDKWYSFEGMDIWGQGTTVTVSS

SEQ ID NO: 239 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTLYNQKFDGRVTLTTDKSTSTAYMELSSLRSEDTAVYYCTRYDKWYSFEGMDIWGQGTTVTVSS

SEQ ID NO: 240 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADESTSTAYMELSSLRSEDTAVYYCTRYDKWESFNGMDYWGQGTTVTVSS

SEQ ID NO: 241 - protein, 121 aa, Artificial Sequence; identical to SEQ ID NO: 113
  Description of Artificial Sequence: Synthetic polypeptide

SEQ ID NO: 242 - protein, 121 aa, Artificial Sequence; identical to SEQ ID NO: 115
  Description of Artificial Sequence: Synthetic polypeptide

SEQ ID NO: 243 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPESGGTFYNQKFDGRVTLTADESTSTAYMELSSLRSEDTAVYYCTRYDKWDSFYGMDYWGQGTTVTVSS

SEQ ID NO: 244 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPESGGTFYNQKFDGRVTLTADESTSTAYMELSSLRSEDTAVYYCTRYDKWYSFEGMDIWGQGTTVTVSS

SEQ ID NO: 245 - protein, 121 aa, Artificial Sequence
  Description of Artificial Sequence: Synthetic polypeptide
EVQLVQSGAEVRKPGSSVKVSCKASGYTFEDYEIHWVRQAPGQGLEWMGVIDPESGGTLYNQKFDGRVTLTADESTSTAYMELSSLRSEDTAVYYCTRYDKWYSFEGMDIWGQGTTVTVSS

SEQ ID NO: 246 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPESGGTFYNQKFDGRVTLTADESTSTAYMELSSLRSEDTAVYYCTRYDKWWSFSGMDYWGQGTTVTVSS

SEQ ID NO: 247 - protein, 121 aa, Artificial Sequence; identical to SEQ ID NO: 30
  Description of Artificial Sequence: Synthetic polypeptide

SEQ ID NO: 248 - protein, 121 aa, Artificial Sequence
  Description of Artificial Sequence: Synthetic polypeptide
EVQLVQSGAEVKKPGSSVKVSCKASGYTFADYEIHWVRQAPGQGLEWIGVNDPESGGTFYNQKFDGRATLTADKSTSTAYMELSSLRSEDTAVYYCTRYDKWESFNGMDYWGQGTTVTVSS

SEQ ID NO: 249 - protein, 121 aa, Artificial Sequence
  Description of Artificial Sequence: Synthetic polypeptide
EVQLVQSGAEVKKPGSSVKVSCKASGYTFADYEIHWVRQAPGQGLEWIGVNDPESGGTFYNQKFDGRATLTADKSTSTAYMELSSLRSEDTAVYYCTRYSKWDSFDGMDYWGQGTTVTVSS

SEQ ID NO: 250 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYDKWYSFEGMDIWGQGTTVTVSS

SEQ ID NO: 251 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADESTSTAYMELSSLRSEDTAVYYCTRYDKWDSFYGMDCWGQGTTVTVSS

SEQ ID NO: 252 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYWKWDSFYGMDSWGQGTTVTVSS

SEQ ID NO: 253 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPESGGTFYNQKFDGRVTLTADKSTSTAYMELSSLRSEDTAVYYCTRYDKWYSFEGMDIWGQGTTVTVSS

SEQ ID NO: 254 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYDKWESFNGMDYWGQGTTVTVSS

SEQ ID NO: 255 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADESTSTAYMELSSLRSEDTAVYYCTRYDKWDGFNGMDYWGQGTTVTVSS

SEQ ID NO: 256 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYSKWDSFLGMDYWGQGTTVTVSS

SEQ ID NO: 257 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWIGVNDPDSGGTLYNQKFDGRVTLTADESTSTAYMELSSLRSEDTAVYYCTRYDKWEGFRGMDLWGQGTTVTVSS

SEQ ID NO: 258 - protein, 121 aa, Artificial Sequence
  Description of Artificial Sequence: Synthetic polypeptide
EVQLVQSGAEVKKPGSSVKVSCKASGYTFTDYEIHWVRQAPGQRLEWIGVNDPESGGTFYNQKFDGRVTLTADESTSTAYMELSSLRSEDTAVYYCTRYDKWESFNGMDYWGQGTTVTVSS

SEQ ID NO: 259 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVIDPESGGTLYNQKFDGRVTITADESTSTAYMELSSLRSEDTAVYYCTRYDRYWSFEGMDYWGQGTTVTVSS

SEQ ID NO: 260 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTLYNQKFDGRVTLTADKSTSTAYMELSSLRSEDTAVYYCTRYDKWYSFEGMDIWGQGTTVTVSS

SEQ ID NO: 261 - protein, 121 aa, Artificial Sequence; identical to SEQ ID NO: 260
  Description of Artificial Sequence: Synthetic polypeptide

SEQ ID NO: 262 - protein, 121 aa, Artificial Sequence
  Description of Artificial Sequence: Synthetic polypeptide
EVQLVQSGAEVKKPGSSVKVSCKASGYTFDEYEIHWVRQAPGQGLEWMGVNDPESGGTLYNQKFDGRVTLTADKSTSTAYMELSSLRSEDTAVYYCTRYDKWDSFYGMDYWGQGTTVTVSS

SEQ ID NO: 263 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTLYNQKFDGRATITADESTSTAYMELSSLRSEDTAVYYCTRYYKWDSFEGMDYWGQGTTVTVSS

SEQ ID NO: 264 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVIDPESGGTLYNQKFDGRVTLTADKSTSTAYMELSSLRSEDTAVYYCTRYDKWYSFEGMDIWGQGTTVTVSS

SEQ ID NO: 265 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRVTLTADKSTSTAYMELSSLRSEDTAVYYCTRYDKYWSFEGMDYWGQGTTVTVSS

SEQ ID NO: 266 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTMYNQKFDGRVTITADKSTSTAYMELSSLRSEDTAVYYCTRYDKWDSFYGMDCWGQGTTVTVSS

SEQ ID NO: 267 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPDSGGTLYNQKFDGRVTITADKSTSTAYMELSSLRSEDTAVYYCTRYDKWESFNGMDYWGQGTTVTVSS

SEQ ID NO: 268 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVIDPDSGGTLYNQKFDGRVTLTADKSTSTAYMELSSLRSEDTAVYYCTRYDKWDSFYGMDYWGQGTTVTVSS

SEQ ID NO: 269 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVIDPESGGILYNQKFDGRVTLTADKSTSTAYMELSSLRSEDTAVYYCTRYDKWESFAGMDYWGQGTTVTVSS

SEQ ID NO: 270 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADKSTSTAYMELSSLRSEDTAVYYCTRYDRWDSFNGMDEWGQGTTVTVSS

SEQ ID NO: 271 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKWESFNGMDYWGQGTTVTVSS

SEQ ID NO: 272 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYWKWDSFYGMDSWGQGTTVTVSS

SEQ ID NO: 273 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWDSFYGMDYWGQGTTVTVSS

SEQ ID NO: 274 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTLYNQKFDGRVTITADESTSTAYMELSSLRSEDTAVYYCTRYDKWESFSGMDYWGQGTTVTVSS

SEQ ID NO: 275 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWYSFEGMDIWGQGTTVTVSS

SEQ ID NO: 276 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPESGGTMYNQKFDGRVTLTADKSTSTAYMELSSLRSEDTAVYYCTRYDKWDSFYGMDCWGQGTTVTVSS

SEQ ID NO: 277 - protein, 121 aa, Artificial Sequence
  Description of Artificial Sequence: Synthetic polypeptide
EVQLVQSWAEVKKPGSSVKVSCKASGYTFTEYEIHWVRQAPGQGLEWIGVNDPESGGTFYNQKFDGRVTLTADESTSTAYMELSSLRSEDTAVYYCTRYDKWESFNGMDYWGQGTTVTVSS

SEQ ID NO: 278 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWDSFYGMDCWGQGTTVTVSS

SEQ ID NO: 279 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVIDPESGGTLYNQKFDGRATLTADKSTSTAYMELSSLRSEDTAVYYCTRYDKWDSFYGMDYWGQGTTVTVSS

SEQ ID NO: 280 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYFKWDSFEGMDYWGQGTTVTVSS

SEQ ID NO: 281 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYWKFDSFYGMDLWGQGTTVTVSS

SEQ ID NO: 282 - protein, 121 aa, Artificial Sequence
  Description of Artificial Sequence: Synthetic polypeptide
EVQLVQSGAEVKKPGSPVKVSCKASGYTFTDYEIHWVRQAPGQGLEWIGVNDPDSGGTLYNQKFDGRVTLTADESTSTAYMELSSLRSEDTAVYYCTRYDKFWSFNGMDYWGQGTTVTVSS

SEQ ID NO: 283 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPESGGTFYNQKFDGRVTLTADESTSTAYMELSSLRSEDTAVYYCTRYDKWESFNGMDYWGQGTTVTVSS

SEQ ID NO: 284 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRVTLTADKSTSTAYMELSSLRSEDTAVYYCTRYDKWDSFYGMDYWGQGTTVTVSS

SEQ ID NO: 285 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWESFNGMDYWGQGTTVTVSS

SEQ ID NO: 286 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTLYNQKFDGRVTITADKSTSTAYMELSSLRSEDTAVYYCTRYEKWDSFNGMDYWGQGTTVTVSS

SEQ ID NO: 287 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKYWSFEGMDYWGQGTTVTVSS

SEQ ID NO: 288 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFQGMDYWGQGTTVTVSS

SEQ ID NO: 289 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADESTSTAYMELSSLRSEDTAVYYCTRYDKWESFAGMDYWGQGTTVTVSS

SEQ ID NO: 290 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRVTLTADKSTSTAYMELSSLRSEDTAVYYCTRYDKYWSFNGMDYWGQGTTVTVSS

SEQ ID NO: 291 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWESFNGMDYWGQGTTVTVSS

SEQ ID NO: 292 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWMGVNDPESGGTLYNQKFDGRVTITADKSTSTAYMELSSLRSEDTAVYYCTRYYKYWSFLGMDYWGQGTTVTVSS

SEQ ID NO: 293 - protein, 121 aa, Artificial Sequence
  Description of Artificial Sequence: Synthetic polypeptide
EVQLVQSGAEVKKPGSSVKVSCKASGYTFEDYEIHWVRQAPGQGLEWIGVNDPESGGTFYNQKFDGRATLTADKSTSTAYMELSSLRSEDTAVYYCTRYDKWDSFYGMDYWGQGTTVTVSS

SEQ ID NO: 294 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTLYNQKFDGRVTITADESTSTAYMELSSLRSEDTAVYYCTRYDKWDSFYGMDYWGQGTTVTVSS

SEQ ID NO: 295 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWESFAGMDYWGQGTTVTVSS

SEQ ID NO: 296 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYSKWDSFQGMDYWGQGTTVTVSS

SEQ ID NO: 297 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKWDSFYGMDYWGQGTTVTVSS

SEQ ID NO: 298 - protein, 121 aa, Artificial Sequence; identical to SEQ ID NO: 271
  Description of Artificial Sequence: Synthetic polypeptide

SEQ ID NO: 299 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRVTLTADESTSTAYMELSSLRSEDTAVYYCTRYDKWDSFYGMDCWGQGTTVTVSS

SEQ ID NO: 300 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDRWDSFNGMDEWGQGTTVTVSS

SEQ ID NO: 301 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTLYNQKFDGRVTITADESTSTAYMELSSLRSEDTAVYYCTRYDKWYSFEGMDIWGQGTTVTVSS

SEQ ID NO: 302 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRATLTADESTSTAYMELSSLRSEDTAVYYCTRYDKWDSFYGMDYWGQGTTVTVSS

SEQ ID NO: 303 - protein, 121 aa, Artificial Sequence
  Description of Artificial Sequence: Synthetic polypeptide
EVQLVQSGAEVKKPGSSVKVSCKASGYTFNDYEIHWVRQAPGQGLEWMGVIDPESGGTLYNQKFDGRATITADESTSTAYMELSSLRSEDTAVYYCTRYDKWYSFEGMDIWGQGTTVTVSS

SEQ ID NO: 304 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFLGMDYWGQGTTVTVSS

SEQ ID NO: 305 - protein, 121 aa, Artificial Sequence
  Description of Artificial Sequence: Synthetic polypeptide
EVQLVQSGAEVKKPGSSVKVSCKASGYTFADYEIHWVRQAPGQGLEWIGVNDPESGGTFYNQKFDGRATLTADESTSTAYMELSSLRSEDTAVYYCTRYDKWDSFYGMDCWGQGTTVTVSS

SEQ ID NO: 306 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWIGVNDPESGGTFYNQKFDGRVTLTADKSTSTAYMELSSLRSEDTAVYYCTRYDKYWSFYGMDYWGQGTTVTVSS

SEQ ID NO: 307 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKFWSFNGMDYWGQGTTVTVSS

SEQ ID NO: 308 - protein, 121 aa, Artificial Sequence; identical to SEQ ID NO: 291
  Description of Artificial Sequence: Synthetic polypeptide

SEQ ID NO: 309 - protein, 121 aa, Artificial Sequence
  Description of Artificial Sequence: Synthetic polypeptide
EVQLVQSGAEVKKPGSSVKVSCKASGYTFEDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 310 - protein, 121 aa, Artificial Sequence
  Description of Artificial Sequence: Synthetic polypeptide
EVQLVQSGAEVKKPRSSVKVSCKASGYTFDDYEIHWVRQAPGQGLEWIGVNDPESGGTFYNQKFDGRATLTADKSTSTAYMELSSLRSEDTAVYYCTRYDKWESFNGMDYWGQGTTVTISS

SEQ ID NO: 311 - protein, 121 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWESFDGMDYWGQGTTVTVSS

SEQ ID NO: 312 - protein, 121 aa, Artificial Sequence; identical to SEQ ID NO: 30
  Description of Artificial Sequence: Synthetic polypeptide

SEQ ID NO: 313 - protein, 121 aa, Artificial Sequence
  Description of Artificial Sequence: Synthetic polypeptide
EVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWESFSGMDHWGQGTTVTVSS

SEQ ID NO: 314 - protein, 121 aa, Artificial Sequence; identical to SEQ ID NO: 30
  Description of Artificial Sequence: Synthetic polypeptide

SEQ ID NO: 315 - protein, 121 aa, Artificial Sequence
  Description of Artificial Sequence: Synthetic polypeptide
EVQLVQSGAEETKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 316 - protein, 121 aa, Artificial Sequence; identical to SEQ ID NO: 30
  Description of Artificial Sequence: Synthetic polypeptide

SEQ ID NO: 317 - protein, 121 aa, Artificial Sequence; identical to SEQ ID NO: 109
  Description of Artificial Sequence: Synthetic polypeptide

SEQ ID NO: 318 - protein, 106 aa, Artificial Sequence
  Description of Artificial Sequence: Synthetic polypeptide
DIQMTQSPSSLSASVGDRVTITCSASSSISYIYWFQQKPGKSPKLWIYATFELASGVPSRFSGSGSGTDYTLTISSLQPEDFATYYCHQRSSYPWTFGQGTKLEIK

SEQ ID NO: 319 - protein, 106 aa, Artificial Sequence
  Description of Artificial Sequence: Synthetic polypeptide
DIQMTQSPSSLSASVGDRVTITCSASSSISYIYWFQQKPGKSPKRWIYATFELASGVPSRFSGSGSGTDYTLTISSLQPEDFATYYCQQRSSYPWTFGQGTKLEIK

SEQ ID NO: 320 - protein, 106 aa, Artificial Sequence
  Description of Artificial Sequence: Synthetic polypeptide
DIQMTQSPSSLSASVGDRVTITCSASSSISYIYWFQQKPGKSPKRWIYATFELASGVPSRFSGSGSGTDYTLTISSLQPEDFATYYCNQRSSYPWTFGQGTKLEIK

SEQ ID NO: 321 - protein, 106 aa, Artificial Sequence
  Description of Artificial Sequence: Synthetic polypeptide
DIQMTQSPSSLSASVGDRVTITCSASSSISYIYWFQQKPGKSPKRWIYATFELASGVPSRFSGSGSGTDYTLTISSLQPEDFATYYCHQRSSYPWTFGQGTKLEIK

SEQ ID NO: 322 - protein, 106 aa, Artificial Sequence
  Description of Artificial Sequence: Synthetic polypeptide
DIQMTQSPSSLSASVGDRVTITCSASSSISYIYWFQQKPGKAPKRLIYATSELASGVPSRFSGSGSGTDYTLTISSLQPEDFATYYCHQRSSYPFTFGQGTKLEIK

SEQ ID NO: 323 - protein, 106 aa, Artificial Sequence
  Description of Artificial Sequence: Synthetic polypeptide
DIQMTQSPSSLSASVGDRVTITCSASSSVRYIYWFQQKPGKSPKRLIYATSDLASGVPSRFSGSGSGTDFTLTISSLQPEDFATYYCHQRSSYPFTFGQGTKLEIK

SEQ ID NO: 324 - protein, 106 aa, Artificial Sequence
  Description of Artificial Sequence: Synthetic polypeptide
DIQMTQSPSSLSASVGDRVTITCSASSSISYIYWFQQKPGKSPKRWIYATSELASGVPSRFSGSGSGTDYTLTISSLQPEDFATYYCHQRSSYPWTFGQGTKLEIK

SEQ ID NO: 325 - protein, 106 aa, Artificial Sequence
  Description of Artificial Sequence: Synthetic polypeptide
DIQMTQSPSSLSASVGDRVTITCSASSSISYIYWFQQKPGKAPKRLIYATSELASGVPSRFSGSGSGTDYTLTISSLQPEDFATYYCHQRSSYPWTFGQGTKLEIK

SEQ ID NO: 326 - protein, 106 aa, Artificial Sequence; identical to SEQ ID NO: 321
  Description of Artificial Sequence: Synthetic polypeptide

SEQ ID NO: 327 - protein, 106 aa, Artificial Sequence; identical to SEQ ID NO: 321
  Description of Artificial Sequence: Synthetic polypeptide

SEQ ID NO: 328 - protein, 106 aa, Artificial Sequence
  Description of Artificial Sequence: Synthetic polypeptide
DIQMTQSPSSLSASVGDRVTITCSASSSISYIYWFQQKPGKSPKRWIYATFELASGVPSRFSGSGSGTDYTLTISSLQPEDFATYYCHQRSSYPWTFGQGIKLEIK

SEQ ID NO: 329 - protein, 106 aa, Artificial Sequence
  Description of Artificial Sequence: Synthetic polypeptide
DIQMTQSPSSLSASVGDRVTITCSASQSVSYIYWFQQKPGKAPKRLIYATSELASGVPSRFSGSGSGTDYTLTISSLQPEDFATYYCHQRSYYPLTFGQGTKLEIK

SEQ ID NO: 330 - protein, 106 aa, Artificial Sequence
  Description of Artificial Sequence: Synthetic polypeptide
DIQMTQSPSSLSASVGDRVTITCSASSIINYIYWFQQKPGKAPKRLIYATSELASGVPSRFSGSGSGTDYTLTISSLQPEDFATYYCHQRSSYPPTFGQGTKLEIK

SEQ ID NO: 331 - protein, 106 aa, Artificial Sequence
  Description of Artificial Sequence: Synthetic polypeptide
DIQMTQSPSSLSASVGDRVTITCSASQSISPIYWFQQKPGKAPKRLIYTTSELASGVPSRFSGSGSGTDYTLTISSLQPEDFATYYCQQRSSYPITFGQGTKLEIK

SEQ ID NO: 332 - protein, 106 aa, Artificial Sequence
  Description of Artificial Sequence: Synthetic polypeptide
DIQMTQSPSSLSASVGDRVTITCRASQSISYLYWFQQKPGKSPKRLIYATSELASGVPSRFSGSGSGTDYTLTISSLQPEDFATYYCQQRSSYPLTFGQGTKLEIK

SEQ ID NO: 333 - protein, 106 aa, Artificial Sequence
  Description of Artificial Sequence: Synthetic polypeptide
DIQMTQSPSSLSASVGDRVTITCSASSIISYIYWFQQKPGKAPKRLIYTTFELASGVPSRFSGSGSGTDYTLTISSLQPEDFATYYCNQRSSYPYTFGQGTKLEIK

SEQ ID NO: 334 - protein, 106 aa, Artificial Sequence
  Description of Artificial Sequence: Synthetic polypeptide
DIQMTQSPSSLSASVGDRVTITCRASQSISYLYWFQQKPGKAPKRLIYATSELASGVPSRFSGSGSGTDFTLTISSLQPEDFATYYCQQRRIYPPTFGQGTKLEIK

SEQ ID NO: 335 - protein, 106 aa, Artificial Sequence
  Description of Artificial Sequence: Synthetic polypeptide
DIQMTQSPSSLSASVGDRVTITCSASSSIRYIYWFQQKPGKAPKRLIYATFELASGVPSRFSGSGSGTDFTLTISSLQPEDFATYYCQQRSSYPLTFGQGTKLEIK

SEQ ID NO: 336 - protein, 106 aa, Artificial Sequence
  Description of Artificial Sequence: Synthetic polypeptide
DIQMTQSPSSLSASVGDRVTITCRASQSISYLYWFQQKPGKSPKRWIYATSELASGVPSRFSGSGSGTDFTLTISSLQPEDFATYYCQQRSNYPLTFGQGTKLEIK

SEQ ID NO: 337 - protein, 106 aa, Artificial Sequence
  Description of Artificial Sequence: Synthetic polypeptide
DIQMTQSPSSLSASVGDRVTITCSASQSISYIYWFQQKPGKSPKRLIYATSELASGVPSRFSGSGSGTDYTLTISSLQPEDFATYYCQQRSSYPYTFGQGTKLEIK

SEQ ID NO: 338 - protein, 106 aa, Artificial Sequence
  Description of Artificial Sequence: Synthetic polypeptide
DIQMTQSPSSLSASVGDRVTITCRASSSISYLYWFQQKPGKAPKRWIYGTFELASGVPSRFSGSGSGTDYTLTISSLQPEDFATYYCQQRSSYPYTFGQGTKLEIK

SEQ ID NO: 339 - protein, 106 aa, Artificial Sequence
  Description of Artificial Sequence: Synthetic polypeptide
DIQMTQSPSSLSASVGDRVTITCRASSSISYLYWFQQKPGKSPKRWIYATSELASGVPSRFSGSGSGTDFTLTISSLQPEDFATYYCQQRSSYPLTFGQGTKLEIK

SEQ ID NO: 340 - protein, 106 aa, Artificial Sequence
  Description of Artificial Sequence: Synthetic polypeptide
DIQMTQSPSSLSASVGDRVTITCSASQSLTYIYWFQQKPGKAPKRLIYATSELASGVPSRFSGSGSGTDFTLTISSLQPEDFATYYCQQRSSYPPTFGQGTKLEIK

SEQ ID NO: 341 - protein, 106 aa, Artificial Sequence
  Description of Artificial Sequence: Synthetic polypeptide
DIQMTQSPSSLSASVGDRVTITCSASQSISYLYWFQQKPGKAPKRLIYATSELASGVPSRFSGSGSGTDFTLTISSLQPEDFATYYCQQRSSYPLTFGQGTKLEIK

SEQ ID NO: 342 - protein, 106 aa, Artificial Sequence
  Description of Artificial Sequence: Synthetic polypeptide
DIQMTQSPSSLSASVGDRVTITCSASSSIRYIYWFQQKPGKAPKRLIYETSDLQSGVPSRFSGSGSGTDFTLTISSLQPEDFATYYCQQRSYYPLTFGQGTKLEIK

SEQ ID NO: 343 - protein, 106 aa, Artificial Sequence
  Description of Artificial Sequence: Synthetic polypeptide
DIQMTQSPSSLSASVGDRVTITCSASSSISYIYWFQQKPGKSPKRLIYSTFELQSGVPSRFSGSGSGTDFTLTISSLQPEDFATYYCQQRSFYPLTFGQGTKLEIK

SEQ ID NO: 344 - protein, 106 aa, Artificial Sequence
  Description of Artificial Sequence: Synthetic polypeptide
DIQMTQSPSSLSASVGDRVTITCSASSIISYIYWFQQKPGKSPKRLIYATSELASGVPSRFSGSGSGTDYTLTISSLQPEDFATYYCHQRSWYPLTFGQGTKLEIK

SEQ ID NO: 345 - protein, 106 aa, Artificial Sequence
  Description of Artificial Sequence: Synthetic polypeptide
DIQMTQSPSSLSASVGDRVTITCSASSSIRYIYWFQQKPGKAPKRLIYATSELASGVPSRFSGSGSGTDFTLTISSLQPEDFATYYCQQRSSYPLTFGQGTKLEIK

SEQ ID NO: 346 - protein, 106 aa, Artificial Sequence
  Description of Artificial Sequence: Synthetic polypeptide
DIQMTQSPSSLSASVGDRVTITCSASQSIRYLYWFQQKPGKSPKRLIYATSELASGVPSRFSGSGSGTDFTLTISSLQPEDFATYYCHQRTRYPFTFGQGTKLEIK

SEQ ID NO: 347 - protein, 106 aa, Artificial Sequence
  Description of Artificial Sequence: Synthetic polypeptide
DIQMTQSPSSLSASVGDRVTITCRASSSISYLYWFQQKPGKSPKRLIYSTSGLASGVPSRFSGSGSGTDYTLTISSLQPEDFATYYCNQRSYYPITFGQGTKLEIK

SEQ ID NO: 348 - protein, 106 aa, Artificial Sequence
  Description of Artificial Sequence: Synthetic polypeptide
DIQMTQSPSSLSASVGDRVTITCRASSIISYIYWFQQKPGKAPKRWIYATSELASGVPSRFSGSGSGTDYTLTISSLQPEDFATYYCQQRSTYPLTFGQGTKLEIK

SEQ ID NO: 349 - protein, 106 aa, Artificial Sequence
  Description of Artificial Sequence: Synthetic polypeptide
DIQMTQSPSSLSASVGDRVTITCSASSSVSYIYWFQQKPGKAPKRWIYATSELASGVPSRFSGSGSGTDFTLTISSLQPEDFATYYCQQRSSYPLTFGQGTKLEIK

SEQ ID NO: 350 - protein, 106 aa, Artificial Sequence
  Description of Artificial Sequence: Synthetic polypeptide
DIQMTQSPSSLSASVGDRVTITCSASSIISYIYWFQQKPGKAPKRLIYATSELASGVPSRFSGSGSGTDYTLTISSLQPEDFATYYCHQRSSYPYTFGQGTKLEIK

SEQ ID NO: 351 - protein, 106 aa, Artificial Sequence
  Description of Artificial Sequence: Synthetic polypeptide
DIQMTQSPSSLSASVGDRVTITCSASSIMNYIYWFQQKPGKAPKRWIYATSELASGVPSRFSGSGSGTDFTLTISSLQPEDFATYYCVQWSLYPPTFGQGTKLEIK

SEQ ID NO: 352 - protein, 106 aa, Artificial Sequence
  Description of Artificial Sequence: Synthetic polypeptide
DIQMTQSPSSLSASVGDRVTITCSASQSIGYLYWFQQKPGKAPKRLIYATSELASGVPSRFSGSGSGTDFTLTISSLQPEDFATYYCQQRSSYPLTFGQGTKLEIK

SEQ ID NO: 353 - protein, 106 aa, Artificial Sequence
  Description of Artificial Sequence: Synthetic polypeptide
DIQMTQSPSSLSASVGDRVTITCRASSIISYIYWFQQKPGKAPKRWIYATFELASGVPSRFSGSGSGTDYTLTISSLQPEDFATYYCHQRSSYPCTFGQGTKLEIK

SEQ ID NO: 354 - protein, 106 aa, Artificial Sequence
  Description of Artificial Sequence: Synthetic polypeptide
DIQMTQSPSSLSASVGDRVTITCRASSSISYLYWFQQKPGKAPKRLIYATSELASGVPSRFSGSGSGTDFTLTISSLQPEDFATYYCHQRSRYPFTFGQGTKLEIK

SEQ ID NO: 355 - protein, 106 aa, Artificial Sequence
  Description of Artificial Sequence: Synthetic polypeptide
DIQMTQSPSSLSASVGDRVTITCSASSSISYLYWFQQKPGKSPKRWIYATSELASGVPSRFSGSGSGTDFTLTISSLQPEDFATYYCHQRSSYPWTFGQGTKLEIK

SEQ ID NO: 356 - protein, 106 aa, Artificial Sequence
  Description of Artificial Sequence: Synthetic polypeptide
DIQMTQSPSSLSASVGDRVTITCSASSSIRYIYWFQQKPGKAPKRWIYATSELASGVPSRFSGSGSGTDFTLTISSLQPEDFATYYCQQRSSYPYTFGQGTKLEIK

SEQ ID NO: 357 - protein, 106 aa, Artificial Sequence
  Description of Artificial Sequence: Synthetic polypeptide
DIQMTQSPSSLSASVGDRVTITCRASSSISYIYWFQQKPGKSPKRWIYATSELASGVPSRFSGSGSGTDYTLTISSLQPEDFATYYCQQRSSYPITFGQGTKLEIK

SEQ ID NO: 358 - protein, 106 aa, Artificial Sequence
  Description of Artificial Sequence: Synthetic polypeptide
DIQMTQSPSSLSASVGDRVTITCRASQSISYLYWFQQKPGKSPKRLIYATSELASGVPSRFSGSGSGTDFTLTISSLQPEDFATYYCHQRSSYPYTFGQGTKLEIK

SEQ ID NO: 359 - protein, 106 aa, Artificial Sequence
  Description of Artificial Sequence: Synthetic polypeptide
DIQMTQSPSSLSASVGDRVTITCSASSSISYLYWFQQKPGKAPKRLIYATSELASGVPSRFSGSGSGTDYTLTISSLQPEDFATYYCNQRSSYPYTFGQGTKLEIK

SEQ ID NO: 360 - protein, 106 aa, Artificial Sequence
  Description of Artificial Sequence: Synthetic polypeptide
DIQMTQSPSSLSASVGDRVTITCSASQSISYIYWFQQKPGKAPKRWIYATSELASGVPSRFSGSGSGTDFTLTISSLQPEDFATYYCNQRSSYPYTFGQGTKLEIK

SEQ ID NO: 361 - protein, 106 aa, Artificial Sequence
  Description of Artificial Sequence: Synthetic polypeptide
DIQMTQSPSSLSASVGDRVTITCSASQIIGYIYWFQQKPGKAPKRWIYATSELASGVPSRFSGSGSGTDYTLTISSLQPEDFATYYCQQRSSYPLTFGQGTKLEIK

SEQ ID NO: 362 - protein, 106 aa, Artificial Sequence
  Description of Artificial Sequence: Synthetic polypeptide
DIQMTQSPSSLSASVGDRVTITCSASQSINYIDWFQQKPGKAPKRWIYATFELASGVPSRFSGSGSGTDYTLTISSLQPEDFATYYCLQRNNYPPTFGQGTKLEIK

SEQ ID NO: 363 - protein, 106 aa, Artificial Sequence
  Description of Artificial Sequence: Synthetic polypeptide
DIQMTQSPSSLSASVGDRVTITCSASSSISYIYWFQQKPGKSPKRLIYSTSELQSGVPSRFSGSGSGTDFTLTISSLQPEDFATYYCQQRTSYPITFGQGTKLEIK

SEQ ID NO: 364 - protein, 106 aa, Artificial Sequence
  Description of Artificial Sequence: Synthetic polypeptide
DIQMTQSPSSLSASVGDRVTITCRASSSISYLYWFQQKPGKSPKRLIYATSELQSGVPSRFSGSGSGTDYTLTISSLQPEDFATYYCQQRSSYPITFGQGTKLEIK

SEQ ID NO: 365 - protein, 106 aa, Artificial Sequence
  Description of Artificial Sequence: Synthetic polypeptide
DIQMTQSPSSLSASVGDRVTITCSASSSISYLYWFQQKPGKSPKRLIYATSELASGVPSRFSGSGSGTDFTLTISSLQPEDFATYYCQQRSLYPITFGQGTKLEIK

SEQ ID NO: 366 - protein, 106 aa, Artificial Sequence
  Description of Artificial Sequence: Synthetic polypeptide
DIQMTQSPSSLSASVGDRVTITCSASQSVRYIYWFQQKPGKAPKRWIYETSELASGVPSRFSGSGSGTDFTLTISSLQPEDFATYYCQQRSSYPLTFGQGTKLEIK

SEQ ID NO: 367 - protein, 106 aa, Artificial Sequence
  Description of Artificial Sequence: Synthetic polypeptide
DIQMTQSPSSLSASVGDRVTITCRASSSISYLYWFQQKPGKSPKRLIYTTFDLASGVPSRFSGSGSGTDFTLTISSLQPEDFATYYCQQRSSYPWTFGQGTKLEIK

SEQ ID NO: 368 - protein, 106 aa, Artificial Sequence
  Description of Artificial Sequence: Synthetic polypeptide
DIQMTQSPSSLSASVGDRVTITCSASQSISYIYWFQQKPGKAPKRLIYSTSELQSGVPSRFSGSGSGTDFTLTISSLQPEDFATYYCQQRSSYPITFGQGTKLEIK

SEQ ID NO: 369 - protein, 106 aa, Artificial Sequence
  Description of Artificial Sequence: Synthetic polypeptide
DIQMTQSPSSLSASVGDRVTITCSASSSISYIYWFQQKPGKAPKRWIYATSELASGVPSRFSGSGSGTDYTLTISSLQPEDFATYYCQQRSSYPLTFGQGTKLEIK

SEQ ID NO: 370 - protein, 106 aa, Artificial Sequence
  Description of Artificial Sequence: Synthetic polypeptide
DIQMTQSPSSLSASVGDRVTITCSASSSISYLYWFQQKPGKSPKRLIYATFELASGVPSRFSGSGSGTDFTLTISSLQPEDFATYYCQQRSSYPLTFGQGTKLEIK

SEQ ID NO: 371 - protein, 106 aa, Artificial Sequence
  Description of Artificial Sequence: Synthetic polypeptide
DIQMTQSPSSLSASVGDRVTITCSASQIMSYIYWFQQKPGKAPKRWIYATSELASGVPSRFSGSGSGTDYTLTISSLQPEDFATYYCQQRSSYPITFGQGTKLEIK

SEQ ID NO: 372 - protein, 106 aa, Artificial Sequence
  Description of Artificial Sequence: Synthetic polypeptide
DIQMTQSPSSLSASVGDRVTITCSASQIINDLFWFQQKPGKAPKRLIYDTFDLQSGVPSRFSGSGSGTDFTLTISSLQPEDFATYYCQQRTHYPITFGQGTKLEIK

SEQ ID NO: 373 - protein, 106 aa, Artificial Sequence
  Description of Artificial Sequence: Synthetic polypeptide
DIQMTQSPSSLSASVGDRVTITCRASQSISYIYWFQQKPGKAPKRWIYATFELASGVPSRFSGSGSGTDYTLTISSLQPEDFATYYCQQRSSYPLTFGQGTKLEIK

SEQ ID NO: 374 - protein, 106 aa, Artificial Sequence
  Description of Artificial Sequence: Synthetic polypeptide
DIQMTQSPSSLSASVGDRVTITCSASQSISYIYWFQQKPGKAPKRLIYGTFDLASGVPSRFSGSGSGTDYTLTISSLQPEDFATYYCQQRSSYPITFGQGTKLEIK

SEQ ID NO: 375 - protein, 106 aa, Artificial Sequence
  Description of Artificial Sequence: Synthetic polypeptide
DIQMTQSPSSLSASVGDRVTITCSASSSISYLYWFQQKPGKAPKRWIYATSELASGVPSRFSGSGSGTDFTLTISSLQPEDFATYYCAQRSGYPYTFGQGTKLEIK

SEQ ID NO: 376 - protein, 106 aa, Artificial Sequence
  Description of Artificial Sequence: Synthetic polypeptide
DIQMTQSPSSLSASVGDRVTITCRASQSIRYIYWFQQKPGKSPKRWIYATSELASGVPSRFSGSGSGTDYTLTISSLQPEDFATYYCQQRSSYPYTFGQGTKLEIK

SEQ ID NO: 377 - protein, 106 aa, Artificial Sequence
  Description of Artificial Sequence: Synthetic polypeptide
DIQMTQSPSSLSASVGDRVTITCRASQSLSYIYWFQQKPGKAPKRWIYATSELASGVPSRFSGSGSGTDYTLTISSLQPEDFATYYCHQRNFYPLTFGQGTKLEIK

SEQ ID NO: 378 - protein, 106 aa, Artificial Sequence
  Description of Artificial Sequence: Synthetic polypeptide
DIQMTQSPSSLSASVGDRVTITCSASQIISYIYWFQQKPGKAPKRLIYGTSQLASGVPSRFSGSGSGTDFTLTISSLQPEDFATYYCQQRSRYPLTFGQGTKLEIK

SEQ ID NO: 379 - protein, 106 aa, Artificial Sequence
  Description of Artificial Sequence: Synthetic polypeptide
DIQMTQSPSSLSASVGDRVTITCSASQSISYIYWFQQKPGKAPKRLIYATSDLQSGVPSRFSGSRSGTDFTLTISSLQPEDFATYYCQQRSSYPLTFGQGTKLEIK

SEQ ID NO: 380 - protein, 106 aa, Artificial Sequence
  Description of Artificial Sequence: Synthetic polypeptide
DIQMTQSPSSLSASVGDRVTITCRASQSISYIYWFQQKPGKAPKRLIYATSELASGVPSRFSGSGSGTDFTLTISSLQPEDFATYYCQQRSLYPLTFGQGTKLEIK

SEQ ID NO: 381 - protein, 106 aa, Artificial Sequence
  Description of Artificial Sequence: Synthetic polypeptide
DIQMTQSPSSLSASVGDRVTITCRASQSLSYIYWFQQKPGKSPKRWIYATSELASGVPSRFSGSGSGTDYTLTISSLQPEDFATYYCHQRSWYPLTFGQGTKLEIK

SEQ ID NO: 382 - protein, 106 aa, Artificial Sequence
  Description of Artificial Sequence: Synthetic polypeptide
DIQMTQSPSSLSASVGDRVTITCRASSSINYLYWFQQKPGKSPKRLIYATFELASGVPSRFSGSGSGTDYTLTISSLQPEDFATYYCNQRSNYPYTFGQGTKLEIK

SEQ ID NO: 383 - protein, 106 aa, Artificial Sequence
  Description of Artificial Sequence: Synthetic polypeptide
DIQMTQSPSSLSASVGDRVTITCRASSIINYIYWFQQKPGKAPKRWIYATSELASGVPSRFSGSGSGTDYTLTISSLQPEDFATYYCQQRSIYPLTFGQGTKLEIK

SEQ ID NO: 384 - protein, 106 aa, Artificial Sequence
  Description of Artificial Sequence: Synthetic polypeptide
DIQMTQSPSSLSASVGDRVTITCRASSSISYIYWFQQKPGKAPKRWIYATSELASGVPSRFSGSGSGTDFTLTISSLQPEDFATYYCQQRSIYPITFGQGTKLEIK

SEQ ID NO: 385 - protein, 106 aa, Artificial Sequence
  Description of Artificial Sequence: Synthetic polypeptide
DIQMTQSPSSLSASVGDRVTITCSASSSISYIYWFQQKPGKSPKRWIYATSLLASGVPSRFSGSGSGTDFTLTISSLQPEDFATYYCLQRSRYPPTFGQGTKLEIK

SEQ ID NO: 386 - protein, 106 aa, Artificial Sequence
  Description of Artificial Sequence: Synthetic polypeptide
DIQMTQSPSSLSASVGDRVTITCRASSIISYIDWYQQKPGKAPKRWIYATFELASGVPSRFSGSGSGTDYTLTISSLQPEDFATYYCLQRSIYPPTFGQGTKLEIK

SEQ ID NO: 387 - protein, 106 aa, Artificial Sequence
  Description of Artificial Sequence: Synthetic polypeptide
DIQMTQSPSSLSASVGDRVTITCRASSSISYLYWFQQKPGKAPKRLIYATSELASGVPSRFSGSGSGTDFTLTISSLQPEDFATYYCQQRSIYPLTFGQGTKLEIK

SEQ ID NO: 388 - protein, 106 aa, Artificial Sequence
  Description of Artificial Sequence: Synthetic polypeptide
DIQMTQSPSSLSASVGDRVTITCSASSSLSYIYWFQQKPGKAPKRWIYATSELASGVPSRFSGSGSGTDYTLTISSLQPEDFATYYCQQRSNYPITFGQGTKLEIK

SEQ ID NO: 389 - protein, 106 aa, Artificial Sequence
  Description of Artificial Sequence: Synthetic polypeptide
DIQMTQSPSSLSASVGDRVTITCRASSILSYIYWFQQKPGKAPKRLIYATSELASGVPSRFSGSGSGTDFTLTISSLQPEDFATYYCQQRSSYPWTFGQGTKLEIK

SEQ ID NO: 390 - protein, 106 aa, Artificial Sequence
  Description of Artificial Sequence: Synthetic polypeptide
DIQMTQSPSSLSASVGDRVTITCSASSSISYIYWFQQKPGKSPKRLIYATSELASGVPSRFSGSGSGTDYTLTISSLQPEDFATYYCQQRSSYPLTFGQGTKLEIK

SEQ ID NO: 391 - protein, 106 aa, Artificial Sequence
  Description of Artificial Sequence: Synthetic polypeptide
DIQMTQSPSSLSASVGDRVTITCSASSSISYLYWFQQKPGKAPKRLIYATSELASGVPSRFSGSGSGTDYTLTISSLQPEDFATYYCQQRSIYPLTFGQGTKLEIK

SEQ ID NO: 392 - protein, 106 aa, Artificial Sequence
  Description of Artificial Sequence: Synthetic polypeptide
DIQMTQSPSSLSASVGDRVTITCSASSSISYIYWFQQKPGKSPKRWIYATSELASGVPSRFSGSGSGTDFTLTISSLQPEDFATYYCQQRSNYPPTFGQGTKLEIK

SEQ ID NO: 393 - protein, 106 aa, Artificial Sequence
  Description of Artificial Sequence: Synthetic polypeptide
DIQMTQSPSSLSASVGDRVTITCSASQIISYLYWFQQKPGKAPKRLIYATSELASGVPSRFSGSGSGTDYTLTISSLQPEDFATYYCQQRSTYPLTFGQGTKLEIK

SEQ ID NO: 394 - protein, 106 aa, Artificial Sequence
  Description of Artificial Sequence: Synthetic polypeptide
DIQMTQSPSSLSASVGDRVTITCRASSSISYIYWFQQKPGKSPKRLIYATFELASGVPSRFSGSGSGTDFTLTISSLQPEDFATYYCQQRSSYPITFGQGTKLEIK

SEQ ID NO: 395 - protein, 106 aa, Artificial Sequence
  Description of Artificial Sequence: Synthetic polypeptide
DIQMTQSPSSLSASVGDRVTITCSASQSVSYIYWFQQKPGKAPKRWIYDTSELASGVPSRFSGSGSGTDFTLTISSLQPEDFATYYCLQQSIYPPTFGQGTKLEIK

SEQ ID NO: 396 - protein, 106 aa, Artificial Sequence
  Description of Artificial Sequence: Synthetic polypeptide
DIQMTQSPSSLSASVGDRVTITCRASSSISYIYWFQQKPGKAPKRLIYATFELASGVPSRFSGSGSGTDYTLTISSLQPEDFATYYCHQRSFYPYTFGQGTKLEIK

SEQ ID NO: 397 - protein, 106 aa, Artificial Sequence
  Description of Artificial Sequence: Synthetic polypeptide
DIQMTQSPSSLSASVGDRVTITCSASSSISYISWFQQKPGKSPKRWIYATSELASGVPSRFSGSGSGTDYTLTISSLQPEDFATYYCLQTAIYPPTFGQGTKLEIK

SEQ ID NO: 398 - protein, 106 aa, Artificial Sequence
  Description of Artificial Sequence: Synthetic polypeptide
DIQMTQSPSSLSASVGDRVTITCSASSSISYIYWFQQKPGKAPKRLIYATSELASGVPSRFSGSGSGTDFTLTISSLQPEDFATYYCNQRSSYPFTFGQGTKLEIK

SEQ ID NO: 399 - protein, 106 aa, Artificial Sequence
  Description of Artificial Sequence: Synthetic polypeptide
DIQMTQSPSSLSASVGDRVTITCRASQSVNYIYWFQQKPGKAPKRWIYATSELQSGVPSRFSGSGSGTDFTLTISSLQPEDFATYYCQQRSFYPLTFGQGTKLEIK

SEQ ID NO: 400 - protein, 106 aa, Artificial Sequence
  Description of Artificial Sequence: Synthetic polypeptide
DIQMTQSPSSLSASVGDRVTITCSASSSISYIYWFQQKPGKAPKRLIYATSELASGVPSRFSGSGSGTDYTLTISSLQPEDFATYYCHQRSSYPYTFGQGTKLEIK

SEQ ID NO: 401 - protein, 106 aa, Artificial Sequence
  Description of Artificial Sequence: Synthetic polypeptide
DIQMTQSPSSLSASVGDRVTITCRASSSLNYIYWFQQKPGKAPKRWIYATSELASGVPSRFSGSRSGTDFTLTISSLQPEDFATYYCQQRMYYPQTFGQGTKLEIK

SEQ ID NO: 402 - protein, 106 aa, Artificial Sequence
  Description of Artificial Sequence: Synthetic polypeptide
DIQMTQSPSSLSASVGDRVTITCSASQSISYIYWFQQKPGKAPKRLIYGTSELASGVPSRFSGSGSGTDFTLTISSLQPEDFATYYCQQRNSYPLTFGQGTKLEIK

SEQ ID NO: 403 - protein, 106 aa, Artificial Sequence
  Description of Artificial Sequence: Synthetic polypeptide
DIQMTQSPSSLSASVGDRVTITCSASSSISYIYWFQQKPGKAPKRLIYATSELASGVPSRFSGSGSGTDFTLTISSLQPEDFATYYCQQRSSYPPTFGQGTKLEIK

SEQ ID NO: 404 - protein, 106 aa, Artificial Sequence
  Description of Artificial Sequence: Synthetic polypeptide
DIQMTQSPSSLSASVGDRVTITCSASSSISYIYWFQQKPGKAPKRLIYATFELASGVPSRFSGSGSGTDFTLTISSLQPEDFATYYCQQRSSYPYTFGQGTKLEIK

SEQ ID NO: 405 - protein, 106 aa, Artificial Sequence
  Description of Artificial Sequence: Synthetic polypeptide
DIQMTQSPSSLSASVGDRVTITCSASQSISYIYWFQQKPGKSPKRWIYATSELASGVPSRFSGSGSGTDYTLTISSLQPEDFATYYCQQRSSYPLTFGQGTKLEIK

SEQ ID NO: 406 - protein, 106 aa, Artificial Sequence
  Description of Artificial Sequence: Synthetic polypeptide
DIQMTQSPSSLSASVGDRVTITCSASSIISYIYWFQQKPGKAPKRLIYATSELASGVPSRFSGSGSGTDFTLTISSLQPEDFATYYCQQRSIYPLTFGQGTKLEIK

SEQ ID NO: 407 - protein, 106 aa, Artificial Sequence
  Description of Artificial Sequence: Synthetic polypeptide
DIQMTQSPSSLSASVGDRVTITCRASQSISYLYWFQQKPGKAPKRLIYATSELASGVPSRFSGSGSGTDFTLTISSLQPEDFATYYCQQRSSYPYTFGQGTKLEIK

SEQ ID NO: 408 - protein, 106 aa, Artificial Sequence
  Description of Artificial Sequence: Synthetic polypeptide
DIQMTQSPSSLSASVGDRVTITCRASSSISYIYWFQQKPGKSPKRLIYATSELASGVPSRFSGSGSGTDYTLTISSLQPEDFATYYCQQRTSYPYTFGQGTKLEIK

SEQ ID NO: 409 - protein, 106 aa, Artificial Sequence
  Description of Artificial Sequence: Synthetic polypeptide
DIQMTQSPSSLSASVGDRVTITCSASSIVSYIYWFQQKPGKAPKRWIYATSELASGVPSRFSGSGSGTDFTLTISSLQPEDFATYYCQQRSSYPLTFGQGTKLEIK

SEQ ID NO: 410 - protein, 106 aa, Artificial Sequence
  Description of Artificial Sequence: Synthetic polypeptide
DIQMTQSPSSLSASVGDRVTITCSASSSISYIYWFQQKPGKSPKRLIYPTFDLQSGVPSRFSGSGSGTDFTLTISSLQPEDFATYYCQQRSMYPITFGQGTKLEIK

SEQ ID NO: 411 - protein, 106 aa, Artificial Sequence
  Description of Artificial Sequence: Synthetic polypeptide
DIQMTQSPSSLSASVGDRVTITCSASSSISYIYWFQQKPGKSPKRLIYATSELASGVPSRFSGSGSGTDFTLTISSLQPEDFATYYCQQRSRYPITFGQGTKLEIK

SEQ ID NO: 412 - protein, 106 aa, Artificial Sequence
  Description of Artificial Sequence: Synthetic polypeptide
DIQMTQSPSSLSASVGDRVTITCSASSIISYIYWFQQKPGKSPKRLIYATSELASGVPSRFSGSGSGTDYTLTISSLQPEDFATYYCQQRSSYPYTFGQGTKLEIK

SEQ ID NO: 413 - protein, 106 aa, Artificial Sequence
  Description of Artificial Sequence: Synthetic polypeptide
DIQMTQSPSSLSASVGDRVTITCSASQSIGYLYWFQQKPGKAPKRWIYATSELASGVPSRFSGSGSGTDYTLTISSLQPEDFATYYCQQRSSYPLTFGQGTKLEIK

SEQ ID NO: 414 - protein, 106 aa, Artificial Sequence
  Description of Artificial Sequence: Synthetic polypeptide
DIQMTQSPSSLSASVGDRVTITCRASSSISYIYWFQQKPGKAPKRWIYATSELASGVPSRFSGSGSGTDFTLTISSLQPEDFATYYCQQRSNYPLTFGQGTKLEIK

SEQ ID NO: 415 - protein, 106 aa, Artificial Sequence
  Description of Artificial Sequence: Synthetic polypeptide
DIQMTQSPSSLSASVGDRVTITCSASSSISYIYWFQQKPGKAPKRWIYATSELASGVPSRFSGSGSGTDFTLTISSLQPEDFATYYCQQRSSYPLTFGQGTKLEIK

SEQ ID NO: 416 - protein, 106 aa, Artificial Sequence
  Description of Artificial Sequence: Synthetic polypeptide
DIQMTQSPSSLSASVGDRVTITCSASSSISYIYWFQQKPGKSPKRLIYATFELASGVPSRFSGSGSGTDYTLTISSLQPEDFATYYCNQRSSYPYTFGQGTKLEIK

SEQ ID NO: 417 - protein, 106 aa, Artificial Sequence
  Description of Artificial Sequence: Synthetic polypeptide
DIQMTQSPSSLSASVGDRVTITCSASSSISYLYWFQQKPGKAPKRWIYATSELASGVPSRFSGSGSGTDYTLTISSLQPEDFATYYCQQRSSYPYTFGQGTKLEIK

SEQ ID NO: 418 - protein, 106 aa, Artificial Sequence
  Description of Artificial Sequence: Synthetic polypeptide
DIQMTQSPSSLSASVGDRVTITCSASSSIDYLYWFQQKPGKAPKRWIYATSQLASGVPSRFSGSGSGTDFTLTISSLQPEDFATYYCQQRSTYPYTFGQGTKLEIK

SEQ ID NO: 419 - protein, 106 aa, Artificial Sequence
  Description of Artificial Sequence: Synthetic polypeptide
DIQMTQSPSSLSASVGDRVTITCSASQSVSYIYWFQQKPGKAPKRLIYATFELASGVPSRFSGSGSGTDFTLTISSLQPEDFATYYCQQRSSYPYTFGQGTKLEIK

SEQ ID NO: 420 - protein, 106 aa, Artificial Sequence
  Description of Artificial Sequence: Synthetic polypeptide
DIQMTQSPSSLSASVGDRVTITCSASQSISYIYWFQQKPGKAPKRLIYATSELASGVPSRFSGSGSGTDYTLTISSLQPEDFATYYCQQRSSYPLTFGQGTKLEIK

SEQ ID NO: 421 - protein, 106 aa, Artificial Sequence
  Description of Artificial Sequence: Synthetic polypeptide
DIQMTQSPSSLSASVGDRVTITCSASSSIGYIYWFQQKPGKSPKRWIYATSELASGVPSRFSGSGSGTDFTLTISSLQPEDFATYYCQQRSSYPITFGQGTKLEIK

SEQ ID NO: 422 - protein, 106 aa, Artificial Sequence
  Description of Artificial Sequence: Synthetic polypeptide
DIQMTQSPSSLSASVGDRVTITCRASQIISYIYWFQQKPGKSPKRWIYATSELASGVPSRFSGSGSGTDYTLTISSLQPEDFATYYCLQRSSYPYTFGQGTKLEIK

SEQ ID NO: 423 - protein, 106 aa, Artificial Sequence
  Description of Artificial Sequence: Synthetic polypeptide
DIQMTQSPSSLSASVGDRVTITCSASSSISYLYWFQQKPGKSPKRLIYETSELQSGVPSRFSGSGSGTDFTLTISSLQPEDFATYYCQQRSSYPFTFGQGTKLEIK

SEQ ID NO: 424 - protein, 106 aa, Artificial Sequence
  Description of Artificial Sequence: Synthetic polypeptide
DIQMTQSPSSLSASVGDRVTITCSASQSIGYIYWFQQKPGKSPKRWIYATSELASGVPSRFSGSGSGTDYTLTISSLQPEDFATYYCQQRSSYPLTFGQGTKLEIK

SEQ ID NO: 425 - protein, 106 aa, Artificial Sequence
  Description of Artificial Sequence: Synthetic polypeptide
DIQMTQSPSSLSASVGDRVTITCRASQSISYIYWFQQKPGKSPKRLIYATSELASGVPSRFSGSGSGTDYTLTISSLQPEDFATYYCQQRSSYPPTFGQGTKLEIK

SEQ ID NO: 426 - protein, 106 aa, Artificial Sequence
  Description of Artificial Sequence: Synthetic polypeptide
DIQMTQSPSSLSASVGDRVTITCRASSSISYIYWFQQKPGKAPKRLIYATSDLASGVPSRFSGSGSGTDFTLTISSLQPEDFATYYCQQRSNYPITFGQGTKLEIK

SEQ ID NO: 427 - protein, 106 aa, Artificial Sequence
  Description of Artificial Sequence: Synthetic polypeptide
DIQMTQSPSSLSASVGDRVTITCSASSIISYLYWFQQKPGKAPKRLIYATSELASGVPSRFSGSGSGTDYTLTISSLQPEDFATYYCQQRSIYPLTFGQGTKLEIK

SEQ ID NO: 428 - protein, 106 aa, Artificial Sequence
  Description of Artificial Sequence: Synthetic polypeptide
DIQMTQSPSSLSASVGDRVTITCSASQSISYIYWFQQKPGKAPKRLIYATFELASGVPSRFSGSGSGTDFTLTISSLQPEDFATYYCQQRSIYPLTFGQGTKLEIK

SEQ ID NO: 429 - protein, 106 aa, Artificial Sequence
  Description of Artificial Sequence: Synthetic polypeptide
DIQMTQSPSSLSASVGDRVTITCSASSSISYLYWFQQKPGKAPKRLIYATSELASGVPSRFSGSGSGTDFTLTISSLQPEDFATYYCNQRSSYPYTFGQGTKLEIK

SEQ ID NO: 430 - protein, 106 aa, Artificial Sequence
  Description of Artificial Sequence: Synthetic polypeptide
DIQMTQSPSSLSASVGDRVTITCSASQSISYIYWFQQKPGKAPKRLIYSTFELQSGVPSRFSGSGSGTDYTLTISSLQPEDFATYYCNQRSSYPYTFGQGTKLEIK

SEQ ID NO: 431 - protein, 106 aa, Artificial Sequence
  Description of Artificial Sequence: Synthetic polypeptide
DIQMTQSPSSLSASVGDRVTITCSASSSISYIYWFQQKPGKAPKRLIYATSELASGVPSRFSGSGSGTDFTLTISSLQPEDFATYYCQQRSSYPYTFGQGTKLEIK

SEQ ID NO: 432 - protein, 106 aa, Artificial Sequence
  Description of Artificial Sequence: Synthetic polypeptide
DIQMTQSPSSLSASVGDRVTITCSASSSISYLYWFQQKPGKSPKRLIYATSELASGVPSRFSGSGSGTDFTLTISSLQPEDFATYYCNQRSIYPYTFGQGTKLEIK

SEQ ID NO: 433 - protein, 106 aa, Artificial Sequence
  Description of Artificial Sequence: Synthetic polypeptide
DIQMTQSPSSLSASVGDRVTITCSASSSINYIYWFQQKPGKSPKRLIYATSELASGVPSRFSGSGSGTDFTLTISSLQPEDFATYYCQQRSMYPFTFGQGTKLEIK

SEQ ID NO: 434 - protein, 106 aa, Artificial Sequence
  Description of Artificial Sequence: Synthetic polypeptide
DIQMTQSPSSLSASVGDRVTITCSASSSISYLYWFQQKPGKAPKRWIYATSELASGVPSRFSGSGSGTDHTLTISSLQPEDFATYYCQQRSSYPLTFGQGTKLEIK

SEQ ID NO: 435 - protein, 106 aa, Artificial Sequence
  Description of Artificial Sequence: Synthetic polypeptide
DIQMTQSPSSLSASVGDRVTITCRASQSINYLYWFQQKPGKAPKRWIYATSELASGVPSRFSGSGSGTDFTLTISSLQPEDFATYYCHQRTNYPPTFGQGTKLEIK

SEQ ID NO: 436 - protein, 107 aa, Artificial Sequence
  Description of Artificial Sequence: Synthetic polypeptide
DIQMTQSPSSLSASVGDRVTITCSASSGSIPYIYWFQQKPGKAPKRLIYGTSGLQSGVPSRFSGSGSGTDFTLTISSLQPEDFATYYCQQRTSYPITFGQGTKLEIK

SEQ ID NO: 437 - protein, 107 aa, Artificial Sequence
  Description of Artificial Sequence: Synthetic polypeptide
DIQMTQSPSSLSASVGDRVTITCRASSGIRRFINWFQQKPGKAPKRLIYATSELQSGVPSRFSGSGSGTDYTLTISSLQPEDFATYYCQQWSSYPWTFGQGTKLEIK

SEQ ID NO: 438 - protein, 107 aa, Artificial Sequence
  Description of Artificial Sequence: Synthetic polypeptide
DIQMTQSPSSLSASVGDRVTITCSASQGSISYIYWFQQKPGKSPKRLIYETFDLQSGVPSRFSGSGSGTDFTLTISSLQPEDFATYYCQQRAIYPITFGQGTKLEIK

SEQ ID NO: 439 - protein, 107 aa, Artificial Sequence
  Description of Artificial Sequence: Synthetic polypeptide
DIQMTQSPSSLSASVGDRVTITCSASQDSINYIYWFQQKPGKAPKRLIYSTSDLQSGVPSRFSGSGSGTDFTLTISSLQPEDFATYYCLQLSRYPPTFGQGTKLEIK

SEQ ID NO: 440 - protein, 107 aa, Artificial Sequence
  Description of Artificial Sequence: Synthetic polypeptide
DIQMTQSPSSLSASVGDRVTITCSASQGSISYIYWFQQKPGKSPKRLIYETFELQSGVPSRFSGSGSGTDFTLTISSLQPEDFATYYCYQKNIYPWTFGQGTKLEIK

SEQ ID NO: 441 - protein, 107 aa, Artificial Sequence
  Description of Artificial Sequence: Synthetic polypeptide
DIQMTQSPSSLSASVGDRVTITCSASQGSINYIYWFQQKPGKAPKRWIYGTSYLASGVPSRFSGSGSGTDFTLTISSLQPEDFATYYCQQRSSYPITFGQGTKLEIK

SEQ ID NO: 442 - protein, 106 aa, Artificial Sequence
  Description of Artificial Sequence: Synthetic polypeptide
DIQMTQSPSSLSASVGDRVTITCRASSSISYIYWFQQKPGKAPKRWIYATSELASGVPSRFSGSGSGTDFTLTISSLQPEDFATYYCNQRSRYPPTFGQGTKLEIK

SEQ ID NO: 443 - protein, 107 aa, Artificial Sequence
  Description of Artificial Sequence: Synthetic polypeptide
DIQMTQSPSSLSASVGDRVTITCRASSSIKSYLNWFQQKPGKAPKRLIYATFELQSGVPSRFSGSGSGTDYTLTISSLQPEDFATYYCQQWRNYPWTFGQGTKLEIK

SEQ ID NO: 444 - protein, 107 aa, Artificial Sequence
  Description of Artificial Sequence: Synthetic polypeptide
DIQMTQSPSSLSASVGDRVTITCRASSDSISYISWFQQKPGKAPKRWIYATSELQSGVPSRFSGSGSGTDFTLTISSLQPEDFATYYCQQPGIYPGTFGQGTKLEIK

SEQ ID NO: 445 - protein, 107 aa, Artificial Sequence
  Description of Artificial Sequence: Synthetic polypeptide
DIQMTQSPSSLSASVGDRVTITCSASQGIFSYLFWYQQKPGKAPKRLIYATSELASGVPSRFSGSGSGTDYTLTISSLQPEDFATYYCQQGSRYPDTFGQGTKLEIK

SEQ ID NO: 446 - protein, 107 aa, Artificial Sequence
  Description of Artificial Sequence: Synthetic polypeptide
DIQMTQSPSSLSASVGDRVTITCSASQGINNYLNWFQQKPGKSPKRWIYATSELQSGVPSRFSGSGSGTDYTLTISSLQPEDFATYYCQQWGSYPWTFGQGTKLEIK

SEQ ID NO: 447 - protein, 107 aa, Artificial Sequence
  Description of Artificial Sequence: Synthetic polypeptide
DIQMTQSPSSLSASVGDRVTITCSASSDIVSYIYWFQQKPGKSPKRLIYATSGLASGVPSRFSGSGSGTDFTLTISSLQPEDFATYYCQQRSSYPITFGQGTKLEIK

SEQ ID NO: 448 - protein, 106 aa, Artificial Sequence
  Description of Artificial Sequence: Synthetic polypeptide
DIQMTQSPSSLSASVGDRVTITCSASSSISYIYWFQQKPGKAPKRLIYATSELASGVPSRFSGSGSGTDYTLTISSLQPEDFATYYCHQRSYYPLTFGQGTKLEIK

SEQ ID NO: 449 - protein, 107 aa, Artificial Sequence
  Description of Artificial Sequence: Synthetic polypeptide
DIQMTQSPSSLSASVGDRVTITCRASSGSIGDLDWFQQKPGKAPKRLIYSTFWLASGVPSRFSGSGSGTDFTLTISSLQPEDFATYYCQQRSIYPPTFGQGTKLEIK

SEQ ID NO: 450 - protein, 107 aa, Artificial Sequence
  Description of Artificial Sequence: Synthetic polypeptide
DIQMTQSPSSLSASVGDRVTITCSASSGSISYIYWFQQKPGKAPKRWIYATSELASGVPSRFSGSGSGTDFTLTISSLQPEDFATYYCQQRSSYPLTFGQGTKLEIK

SEQ ID NO: 451 - protein, 107 aa, Artificial Sequence
  Description of Artificial Sequence: Synthetic polypeptide
DIQMTQSPSSLSASVGDRVTITCSASQGIISYIDWFQQKPGKAPKRLIYATFELASGVPSRFSGSGSGTDFTLTISSLQPEDFATYYCHQLGSYPDTFGQGTKLEIK

SEQ ID NO: 452 - protein, 107 aa, Artificial Sequence
  Description of Artificial Sequence: Synthetic polypeptide
DIQMTQSPSSLSASVGDRVTITCSASSGIISSIDWFQQKPGKAPKRLIYATSELQSGVPSRFSGSGSGTDYTLTISSLQPEDFATYYCQQWMSYPLTFGQGTKLEIK

SEQ ID NO: 453 - protein, 107 aa, Artificial Sequence
  Description of Artificial Sequence: Synthetic polypeptide
DIQMTQSPSSLSASVGDRVTITCSASSGSINYIYWFQQKPGKSPKRLIYSTSDLQSGVPSRFSGSGSGTDFTLTISSLQPEDFATYYCQQRSIYPITFGQGTKLEIK

SEQ ID NO: 454 - protein, 107 aa, Artificial Sequence; identical to SEQ ID NO: 119
  Description of Artificial Sequence: Synthetic polypeptide

SEQ ID NO: 455 - protein, 107 aa, Artificial Sequence
  Description of Artificial Sequence: Synthetic polypeptide
DIQMTQSPSSLSASVGDRVTITCSASSGSISYIYWFQQKPGKAPKRLIYDTFELASGVPSRFSGSGSGTDFTLTISSLQPEDFATYYCYQKKLYPWTFGQGTKLEIK

SEQ ID NO: 456 - protein, 107 aa, Artificial Sequence
  Description of Artificial Sequence: Synthetic polypeptide
DIQMTQSPSSLSASVGDRVTITCSASSGSISYIYWFQQKPGKAPKRWIYATSELASGVPSRFSGSGSGTDFTLTISSLQPEDFATYYCQQRSIYPLTFGQGTKLEIK

SEQ ID NO: 457 - protein, 107 aa, Artificial Sequence
  Description of Artificial Sequence: Synthetic polypeptide
DIQMTQSPSSLSASVGDRVTITCSASSDISSYLNWFQQKPGKSPKRLIYRTSELQSGVPSRFSGSGSGTDFTLTISSLQPEDFATYYCHQLGSYPDTFGQGTKLEIK

SEQ ID NO: 458 - protein, 107 aa, Artificial Sequence
  Description of Artificial Sequence: Synthetic polypeptide
DIQMTQSPSSLSASVGDRVTITCSASSDSVSYIYWFQQKPGKAPKRLIYATSELQSGVPSRFSGSGSGTDFTLTISSLQPEDFATYYCQQRSSYPITFGQGTKLEIK

SEQ ID NO: 459 - protein, 107 aa, Artificial Sequence
  Description of Artificial Sequence: Synthetic polypeptide
DIQMTQSPSSLSASVGDRVTITCSASQGSVSNIDWFQQKPGKAPKRLIYATFHLASGVPSRFSGSGSGTDFTLTISSLQPEDFATYYCLQRGSYPGTFGQGTKLEIK

SEQ ID NO: 460 - protein, 107 aa, Artificial Sequence
  Description of Artificial Sequence: Synthetic polypeptide
DIQMTQSPSSLSASVGDRVTITCSASSGIISYIGWFQQKPGKAPKRLIYATSELASGVPSRFSGSGSGTDFTLTISSLQPEDFATYYCHQPGIYPGTFGQGTKLEIK

SEQ ID NO: 461 - protein, 107 aa, Artificial Sequence
  Description of Artificial Sequence: Synthetic polypeptide
DIQMTQSPSSLSASVGDRVTITCSASQGIISYINWYQQKPGKAPKRLIYSTSELASGVPSRFSGSGSGTDYTLTISSLQPEDFATYYCQQQGSYPDTFGQGTKLEIK

SEQ ID NO: 462 - protein, 107 aa, Artificial Sequence
  Description of Artificial Sequence: Synthetic polypeptide
DIQMTQSPSSLSASVGDRVTITCSASSGSISYLYWFQQKPGKAPKRLIYRTSELQSGVPSRFSGSGSGTDFTLTISSLQPEDFATYYCQQWSSYPWTFGQGTKLEIK

SEQ ID NO: 463 - protein, 107 aa, Artificial Sequence
  Description of Artificial Sequence: Synthetic polypeptide
DIQMTQSPSSLSASVGDRVTITCSASSDISSYLNWFQQKPGKAPKRLIYPTFELQSGVPSRFSSSGSGTDFTLTISSLQPEDFATYYCLQFSIYPPTFGQGTKLEIK

SEQ ID NO: 464 - protein, 107 aa, Artificial Sequence
  Description of Artificial Sequence: Synthetic polypeptide
DIQMTQSPSSLSASVGDRVTITCSASQDSIRYIYWFQQKPGKAPKRLIYATSELASGVPSRFSGSGSGTDFTLTISSLQPEDFATYYCYQGTIYPPTFGQGTKLEIK

SEQ ID NO: 465 - protein, 107 aa, Artificial Sequence
  Description of Artificial Sequence: Synthetic polypeptide
DIQMTQSPSSLSASVGDRVTITCRASSGINGYIYWFQQKPGKAPKRLFYSTFELQSGVPSRFSGSGSGTDFTLTISSLQPEDFATYYCQQRSFYPLTFGQGTKLEIK

SEQ ID NO: 466 - protein, 107 aa, Artificial Sequence
  Description of Artificial Sequence: Synthetic polypeptide
DIQMTQSPSSLSASVGDRVTITCSASSGIISSIDWFQQKPGKAPKRLIYDTFELASGVPSRFSGSGSGTDFTLTISSLQPEDFATYYCSQMSSYPHTFGQGTKLEIK

SEQ ID NO: 467 - protein, 107 aa, Artificial Sequence
  Description of Artificial Sequence: Synthetic polypeptide
DIQMTQSPSSLSASVGDRVTITCSASSGSISYIYWFQQKPGKAPKRWIYATSELASGVPSRFSGSGSGTDFTLTISSLQPEDFATYYCQQRSSYPITFGQGTKLEIK

SEQ ID NO: 468 - protein, 107 aa, Artificial Sequence
  Description of Artificial Sequence: Synthetic polypeptide
DIQMTQSPSSLSASVGDRVTITCSASSSSISYIYWFQQKPGKAPKRLIYATSELASGVPSRFSGSGSGTDFTLTISSLQPEDFATYYCQQRSRYPYTFGQGTKLEIK

SEQ ID NO: 469 - protein, 107 aa, Artificial Sequence
  Description of Artificial Sequence: Synthetic polypeptide
DIQMTQSPSSLSASVGDRVTITCSASSSIISNLYWFQQKPGKAPKRWIYQTFELASGVPSRFSGSESGTDFTLTISSLQPEDFATYYCYQGSTYPPTFGQGTKLEIK

SEQ ID NO: 470 - protein, 107 aa, Artificial Sequence
  Description of Artificial Sequence: Synthetic polypeptide
DIQMTQSPSSLSASVGDRVTITCSASSGSISYIYWFQQKPGKSPKRLIYATSELASGVPSRFSGSGSGTDFTLTISSLQPEDFATYYCQQRSIYPITFGQGTKLEIK

SEQ ID NO: 471 - protein, 107 aa, Artificial Sequence
  Description of Artificial Sequence: Synthetic polypeptide
DIQMTQSPSSLSASVGDRVTITCSASSDISSYLNWFQQKPGKSPKRLIYRTSELQSGVPSRFSGSGSGTDFTLTISSLQPEDFATYYCHQFSSYPQTFGQGTKLEIK

SEQ ID NO: 472 - protein, 107 aa, Artificial Sequence
  Description of Artificial Sequence: Synthetic polypeptide
DIQMTQSPSSLSASVGDRVTITCSASSGSISYIYWFQQKPGKAPKRWIYATSELASGVPSRFSGSGSGTDFTLTISSLQPEDFATYYCHQRSSYPYTFGQGTKLEIK

SEQ ID NO: 473 - protein, 107 aa, Artificial Sequence
  Description of Artificial Sequence: Synthetic polypeptide
DIQMTQSPSSLSASVGDRVTITCSASSSSINYIYWFQQKPGKAPKRWIYATSELASGVPSRFSGSGSGTDYTLTISSLQPEDFATYYCQQRSIYPLTFGQGTKLEIK

SEQ ID NO: 474 - protein, 107 aa, Artificial Sequence
  Description of Artificial Sequence: Synthetic polypeptide
DIQMTQSPSSLSASVGDRVTITCRASSGIVSYLYWFQQKPGKAPKRWIYATSELASGVPSRFSGSGSGTDYTLTISSLQPEDFATYYCQQRSSYPITFGQGTKLEIK

SEQ ID NO: 475 - protein, 107 aa, Artificial Sequence
  Description of Artificial Sequence: Synthetic polypeptide
DIQMTQSPSSLSASVGDRVTITCSASSDSISYIYWFQQKPGKAPKRLIYDTFELQSGVPSRFSGSGSGTDFTLTISSLQPEDFATYYCQQRSRYPITFGQGTKLEIK

SEQ ID NO: 476 - protein, 107 aa, Artificial Sequence
  Description of Artificial Sequence: Synthetic polypeptide
DIQMTQSPSSLSASVGDRVTITCSASQTSLSAIYWFQQKPGKAPKRLIYMTSELASGVPSRFSGSGSGTDYTLTISSLQPEDFATYYCYQSSRYPPTFGQGTKLEIK

SEQ ID NO: 477 - protein, 107 aa, Artificial Sequence
  Description of Artificial Sequence: Synthetic polypeptide
DIQMTQSPSSLSASVGDRVTITCRASSGIISYLQWFQQKPGKAPKRWIYATSELASGVPSRFSGSGSGTDFTLTISSLQPEDFATYYCLQVSSYPPTFGQGTKLEIK

SEQ ID NO: 478 - protein, 107 aa, Artificial Sequence; identical to SEQ ID NO: 118
  Description of Artificial Sequence: Synthetic polypeptide

SEQ ID NO: 479 - protein, 107 aa, Artificial Sequence
  Description of Artificial Sequence: Synthetic polypeptide
DIQMTQSPSSLSASVGDRVTITCRASSGSINYIYWFQQKPGKAPKRWIYATSELASGVPSRFSGSGSGTDYTLTISSLQPEDFATYYCQQRSSYPYTFGQGTKLEIK

SEQ ID NO: 480 - protein, 107 aa, Artificial Sequence
  Description of Artificial Sequence: Synthetic polypeptide
DIQMTQSPSSLSASVGDRVTITCRASQDSISYIYWFQQKPGKAPKRWIYATSELASGVPSRFSGSGSGTDFTLTISSLQPEDFATYYCQQRSSYPITFGQGTKLEIK

SEQ ID NO: 481 - protein, 107 aa, Artificial Sequence
  Description of Artificial Sequence: Synthetic polypeptide
DIQMTQSPSSLSASVGDRVTITCSASSDSISYIYWFQQKPGKAPKRWIYATSELASGVPSRFSGSGSGTDFTLTISSLQPEDFATYYCQQRSFYPLTFGQGTKLEIK

SEQ ID NO: 482 - protein, 107 aa, Artificial Sequence
  Description of Artificial Sequence: Synthetic polypeptide
DIQMTQSPSSLSASVGDRVTITCRASQGIISYIYWFQQKPGKAPKRLIYDTSELASGVPSRFSGSGSGTDFTLTISSLQPEDFATYYCYQKSIYPWTFGQGTKLEIK

SEQ ID NO: 483 - protein, 107 aa, Artificial Sequence
  Description of Artificial Sequence: Synthetic polypeptide
DIQMTQSPSSLSASVGDRVTITCSASSEIVSYIYWFQQKPGKAPKRLIYATSELASGVPSRFSGSGSGTDYTLTISSLQPEDFATYYCQQRSSYPPTFGQGTKLEIK

SEQ ID NO: 484 - protein, 107 aa, Artificial Sequence
  Description of Artificial Sequence: Synthetic polypeptide
DIQMTQSPSSLSASVGDRVTITCSASQGSLRYIYWFQQKPGKAPKRWIYATSELASGVPSRFSGSGSGTDFTLTISSLQPEDFATYYCQQRSSYPLTFGQGTKLEIK

SEQ ID NO: 485 - protein, 107 aa, Artificial Sequence
  Description of Artificial Sequence: Synthetic polypeptide
DIQMTQSPSSLSASVGDRVTITCRASSGSIRDLYWFQQKPGKAPKRLIYDTFELASGVPSRFSGSGSGTDYTLTISSLQPEDFATYYCYQKSTYPWTFGQGTKLEIK

SEQ ID NO: 486 - protein, 107 aa, Artificial Sequence
  Description of Artificial Sequence: Synthetic polypeptide
DIQMTQSPSSLSASVGDRVTITCSASSGSINYLYWFQQKPGKAPKRLIYDTFYLASGVPSRFSGSGSGTDFTLTISSLQPEDFATYYCYQKSTYPWTFGQGTKLEIK

SEQ ID NO: 487 - protein, 107 aa, Artificial Sequence
  Description of Artificial Sequence: Synthetic polypeptide
DIQMTQSPSSLSASVGDRVTITCRASQSSIRYLYWYQQKPGKAPKRLIYATSELASGVPSRFSGSGSGTDYTLTISSLQPEDFATYYCQQRDIYPPTFGQGTKLEIK

SEQ ID NO: 488 - protein, 107 aa, Artificial Sequence
  Description of Artificial Sequence: Synthetic polypeptide
DIQMTQSPSSLSASVGDRVTITCSASQGIGSYIYWFQQKPGKAPKRWIYATSELASGVPSRFSGSGSGTDFTLTISSLQPEDFATYYCHQRSSYPYTFGQGTKLEIK

SEQ ID NO: 489 - protein, 107 aa, Artificial Sequence
  Description of Artificial Sequence: Synthetic polypeptide
DIQMTQSPSSLSASVGDRVTITCRASSGSIRDLYWFQQKPGKAPKRWIYQTSELASGVPSRFSGSGSGTDFTLTISSLQPEDFATYYCQQVSSYPPTFGQGTKLEIK

SEQ ID NO: 490 - protein, 107 aa, Artificial Sequence
  Description of Artificial Sequence: Synthetic polypeptide
DIQMTQSPSSLSASVGDRVTITCSASQASISYIYWFQQKPGKAPKRLIYDTFELQSGVPSRFSGSGSGTDFTLTISSLQPEDFATYYCQQRSSYPITFGQGTKLEIK

SEQ ID NO: 491 - protein, 107 aa, Artificial Sequence
  Description of Artificial Sequence: Synthetic polypeptide
DIQMTQSPSSLSASVGDTVTITCRASQVSISYIYWFQQKPGKAPKRWIYATSELASGVPSRFSGSGSGTDFTLTISSLQPEDFATYYCQQRSSYPYTFGQGTKLEIK

SEQ ID NO: 492 - protein, 107 aa, Artificial Sequence
  Description of Artificial Sequence: Synthetic polypeptide
DIQMTQSPSSLSASVGDRVTITCSASSDISSYLNWFQQKPGKSPKRLIYRTSELQSGVPSRFSGSGSGTDFTLTISSLQPEDFATYYCQQRSFYPLTFGQGTKLEIK

SEQ ID NO: 493 - protein, 107 aa, Artificial Sequence
  Description of Artificial Sequence: Synthetic polypeptide
DIQMTQSPSSLSASVGDRVTITCRASSDIFSCIFWFQQKPGKAPKRLIYETFDLASGVPSRFSGSGSGTDYTLTISSLQPEDFATYYCLQWSSYPPTFGQGTKLEIK

SEQ ID NO: 494 - protein, 107 aa, Artificial Sequence
  Description of Artificial Sequence: Synthetic polypeptide
DIQMTQSPSSLSASVGDRVTITCSASSGIGSYIYWFQQKPGKAPKRWIYATSELASGVPSRFSGSGSGTDFTLTISSLQPEDFATYYCHQRSSYPYTFGQGTKLEIK

SEQ ID NO: 495 - protein, 107 aa, Artificial Sequence
  Description of Artificial Sequence: Synthetic polypeptide
DIQMTQSPSSLSASVGDRVTITCSASQGIKGYLNWFQQKPGKAPKRLIYATFELQSGVPSRFSGSGSGTDYTLTISSLQPEDFATYYCQQWSKYPWTFGQGTKLEIK

SEQ ID NO: 496 - protein, 107 aa, Artificial Sequence
  Description of Artificial Sequence: Synthetic polypeptide
DIQMTQSPSSLSASVGDRVTITCSASSGSISYIDWFQQKPGKAPKRLIYATFELASGVPSRFSGSGSGTDFTLTISSLQPEDFATYYCHQFSSYPQTFGQGTKLEIK

SEQ ID NO: 497 - protein, 107 aa, Artificial Sequence
  Description of Artificial Sequence: Synthetic polypeptide
DIQMTQSPSSLSASVGDRVTITCSASQGIGSYIYWFQQKPGKAPKRWIYATSELASGVPSRFSGSGSGTDFTLTISSLQPEDFATYYCYQDSRYPPTFGQGTKLEIK

SEQ ID NO: 498 - protein, 107 aa, Artificial Sequence
  Description of Artificial Sequence: Synthetic polypeptide
DIQMTQSPSSLSASVGDRVTITCRASQDSIRYIYWFQQKPGKAPKRLIYATFELASGVPSRFSGSGSGTDYTLTISSLQPEDFATYYCNQRSNYPYTFGQGTKLEIK

SEQ ID NO: 499 - protein, 107 aa, Artificial Sequence
  Description of Artificial Sequence: Synthetic polypeptide
DIQMTQSPSSLSASVGDRVTITCSASSGSLSYIYWFQQKPGKAPKRWIYATSELASGVPSRFSGSGSGTDYTLTISSLQPEDFATYYCQQRSIYPYTFGQGTKLEIK

SEQ ID NO: 500 - protein, 107 aa, Artificial Sequence
  Description of Artificial Sequence: Synthetic polypeptide
DIQMTQSPSSLSASVGDRVTITCSASSGSISYIDWFQQKPGKSPKRLIYATFELASGVPSRFSGSGSGTDYTLTISSLQPEDFATYYCHQIGSYPGTFGQGTKLEIK

SEQ ID NO: 501 - protein, 107 aa, Artificial Sequence
  Description of Artificial Sequence: Synthetic polypeptide
DIQMTQSPSSLSASVGDRVTITCRASSGIISYVDWFQQKPGKAPKRLIYATFELASGVPSRFSGSGSGTDFTLTISSLQPEDFATYYCHQIGIYPRTFGQGTKLEIK

SEQ ID NO: 502 - protein, 107 aa, Artificial Sequence
  Description of Artificial Sequence: Synthetic polypeptide
DIQMTQSPSSLSASVGDRVTITCKASSGIIGYIDWFQQKPGKAPKRLIYATFDLASGVPSRFSGSGSGTDYTLTISSLQPEDFATYYCRQVGSYPETFGQGTKLEIK

SEQ ID NO: 503 - protein, 107 aa, Artificial Sequence
  Description of Artificial Sequence: Synthetic polypeptide
DIQMTQSPSSLSASVGDRVTITCRASSGINRYIDWFQQKPGKAPKRLIYATFDLASGVPSRFSGSGSGTDYTLTISSLQPEDFATYYCRQVGSYPETFGQGTKLEIK

SEQ ID NO: 504 - protein, 107 aa, Artificial Sequence
  Description of Artificial Sequence: Synthetic polypeptide
DIQMTQSPSSLSASVGDRVTITCSASQGIGSYIYWFQQKPGKAPKRWIYATSELASGVPSRFSGSGSGTDFTLTISSLQPEDFATYYCQQRSSYPITFGQGTKLEIK

SEQ ID NO: 505 - protein, 107 aa, Artificial Sequence; identical to SEQ ID NO: 120
  Description of Artificial Sequence: Synthetic polypeptide

SEQ ID NO: 506 - protein, 107 aa, Artificial Sequence
  Description of Artificial Sequence: Synthetic polypeptide
DIQMTQSPSSLSASVGDRVTITCSASSASVRYIDWFQQKPGKAPKRLIYATFDLASGVPSRFSGSGSGTDYTLTISSLQPEDFATYYCRQVGSYPETFGQGTKLEIK

SEQ ID NO: 507 - protein, 107 aa, Artificial Sequence
  Description of Artificial Sequence: Synthetic polypeptide
DIQMTQSPSSLSASVGDRVTITCRASSGIRSYIDWFQQKPGKSPKRLIYATFDLASGVPSRFSGSGSGTDYTLTISSLQPEDFATYYCRQVGNYPGTFGQGTKLEIK

SEQ ID NO: 508 - protein, 107 aa, Artificial Sequence
  Description of Artificial Sequence: Synthetic polypeptide
DIQMTQSPSSLSASVGDRVTITCSASQGSNCYLDWFQQKPGKAPKRLIYATSELASGVPSRFSSSGSGTDYTLTISSLQPEDFATYYCHQLSSYPNTFGQGTKLEIK

SEQ ID NO: 509 - protein, 107 aa, Artificial Sequence
  Description of Artificial Sequence: Synthetic polypeptide
DIQMTQSPSSLSASVGDRVTITCSASSDINSYIDWFQQKPGKAPKRLIYATFELASGVPSRFSGSGSGTDYTLTISSLQPEDFATYYCHQLGSYPRTFGQGTKLEIK

SEQ ID NO: 510 - protein, 107 aa, Artificial Sequence
  Description of Artificial Sequence: Synthetic polypeptide
DIQMTQSPSSLSASVGDRVTITCSASQGSISYIDWFQQKPGKAPKRLIYATFDLASGVPSRFSGSGSGTDYTLTISSLQPEDFATYYCRQVGSYPETFGQGTKLEIK

SEQ ID NO: 511 - protein, 107 aa, Artificial Sequence; identical to SEQ ID NO: 117
  Description of Artificial Sequence: Synthetic polypeptide

SEQ ID NO: 512 - protein, 107 aa, Artificial Sequence
  Description of Artificial Sequence: Synthetic polypeptide
DIQMTQSPSSLSASVGDRVTITCSASSGSISYIDWFQQKPGKAPKRLIYATFELASGVPSRFSGSGSGTDYTLTISSLQPEDFATYYCRQVGSYPETFGQGTKLEIK

SEQ ID NO: 513 - protein, 107 aa, Artificial Sequence
  Description of Artificial Sequence: Synthetic polypeptide
DIQMTQSPSSLSASVGDRVTITCSASQGIFSYIDWFQQKPGKAPKRLIYATFDLASGVPSRFSGSGSGTDYTLTISSLQPEDFATYYCRQVGSYPETFGQGTKLEIK

SEQ ID NO: 514 - protein, 107 aa, Artificial Sequence
  Description of Artificial Sequence: Synthetic polypeptide
DIQMTQSPSSLSASVGDRVTITCSASSGSISYIDWFQQKPGKAPKRLIYATFDLASGVPSRFSSSGSGTDYTLTISSLQPEDFATYYCHQLGSYPGTFGQGTKLEIK

SEQ ID NO: 515 - protein, 107 aa, Artificial Sequence; identical to SEQ ID NO: 117
  Description of Artificial Sequence: Synthetic polypeptide

SEQ ID NO: 516 - protein, 107 aa, Artificial Sequence
  Description of Artificial Sequence: Synthetic polypeptide
DIQMTQSPSSLSASVGDRVTITCRASSGIPSYIDWFQQKPGKAPKRLIYATFELASGVPSRFSGSGSGTDYTLTISSLQPEDFATYYCRQLGSYPRTFGQGTKLEIK

SEQ ID NO: 517 - protein, 107 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGHGTKLEIK

SEQ ID NO: 518 - protein, 107 aa, Artificial Sequence; identical to SEQ ID NO: 117
  Description of Artificial Sequence: Synthetic polypeptide

SEQ ID NO: 519 - protein, 107 aa, Artificial Sequence
  Description of Artificial Sequence: Synthetic polypeptide
DIQMTQSPSSLSASVGDRVTITCSASQGIISYIDWFQQKPGKAPKRLIYATFELASGVPSRFSGSGSGTDFTLTISSLQPEDFATYYCRQVGSYPETFGQGTKLEIK

SEQ ID NO: 520 - protein, 107 aa, Artificial Sequence
  Description of Artificial Sequence: Synthetic polypeptide
DIQMTQSPSSLSVSVGDRVTITCRASSGIISYIDWFQQKPGKAPKRLIYATFDLASGVPSRFSGSGSGTDYTLTISSLQPEDFATYYCRQVGSYPETFGQGTKLEIK

SEQ ID NO: 521 - protein, 107 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGAKLEIK

SEQ ID NO: 522 - protein, 107 aa, Artificial Sequence; identical to SEQ ID NO: 117
  Description of Artificial Sequence: Synthetic polypeptide

SEQ ID NO: 523 - protein, 107 aa, Artificial Sequence; identical to SEQ ID NO: 116
  Description of Artificial Sequence: Synthetic polypeptide

SEQ ID NO: 524 - protein, 107 aa, Artificial Sequence
  Description of Artificial Sequence: Synthetic polypeptide
DIQMTQSPSSLSASVGDRVTITCSASSGSISYIDWFQQKPGKAPKRLIYATFDLASGVPSRFSGSGSGTDYTLTISSLQPEDFATYYCRQVGSYPETFGQGTKLEIK

SEQ ID NO: 525 - protein, 107 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPDTFGQGTKLEIK

SEQ ID NO: 526 - protein, 107 aa, Artificial Sequence
  Description of Artificial Sequence: Synthetic polypeptide
DIQMTQSPSSLSTSVGDRVTITCRASSGIISYIDWFQQKPGKAPKRLIYATFDLASGVPSRFSGSGSGTDYTLTISSLQPEDFATYYCRQVGSYPETFGQGTKLEIK

SEQ ID NO: 527 - protein, 121 aa, Artificial Sequence; identical to SEQ ID NO: 108
  Description of Artificial Sequence: Synthetic polypeptide

SEQ ID NO: 528 - protein, 121 aa, Artificial Sequence; identical to SEQ ID NO: 109
  Description of Artificial Sequence: Synthetic polypeptide

SEQ ID NO: 529 - protein, 121 aa, Artificial Sequence; identical to SEQ ID NO: 30
  Description of Artificial Sequence: Synthetic polypeptide

SEQ ID NO: 530 - protein, 121 aa, Artificial Sequence; identical to SEQ ID NO: 111
  Description of Artificial Sequence: Synthetic polypeptide

SEQ ID NO: 531 - protein, 121 aa, Artificial Sequence; identical to SEQ ID NO: 112
  Description of Artificial Sequence: Synthetic polypeptide

SEQ ID NO: 532 - protein, 121 aa, Artificial Sequence; identical to SEQ ID NO: 113
  Description of Artificial Sequence: Synthetic polypeptide

SEQ ID NO: 533 - protein, 121 aa, Artificial Sequence; identical to SEQ ID NO: 114
  Description of Artificial Sequence: Synthetic polypeptide

SEQ ID NO: 534 - protein, 121 aa, Artificial Sequence; identical to SEQ ID NO: 115
  Description of Artificial Sequence: Synthetic polypeptide

SEQ ID NO: 535 - protein, 107 aa, Artificial Sequence; identical to SEQ ID NO: 116
  Description of Artificial Sequence: Synthetic polypeptide

SEQ ID NO: 536 - protein, 107 aa, Artificial Sequence; identical to SEQ ID NO: 117
  Description of Artificial Sequence: Synthetic polypeptide

SEQ ID NO: 537 - protein, 107 aa, Artificial Sequence; identical to SEQ ID NO: 118
  Description of Artificial Sequence: Synthetic polypeptide

SEQ ID NO: 538 - protein, 107 aa, Artificial Sequence; identical to SEQ ID NO: 119
  Description of Artificial Sequence: Synthetic polypeptide

SEQ ID NO: 539 - protein, 107 aa, Artificial Sequence; identical to SEQ ID NO: 120
  Description of Artificial Sequence: Synthetic polypeptide

SEQ ID NO: 540 - protein, 248 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 541 - protein, 117 aa, Artificial Sequence; identical to SEQ ID NO: 58
  Description of Artificial Sequence: Synthetic polypeptide

SEQ ID NO: 542 - protein, 10 aa, Artificial Sequence
  Description of Artificial Sequence: Synthetic peptide
GGGGSGGGGS

SEQ ID NO: 543 - protein, 121 aa, Artificial Sequence; identical to SEQ ID NO: 30
  Description of Artificial Sequence: Synthetic polypeptide

SEQ ID NO: 544 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 545 - protein, 225 aa, Artificial Sequence
  Description of Artificial Sequence: Synthetic polypeptide
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRGGSGGGGSGDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 546 - protein, 108 aa, Artificial Sequence; identical to SEQ ID NO: 78
  Description of Artificial Sequence: Synthetic polypeptide

SEQ ID NO: 547 - protein, 9 aa, Artificial Sequence
  Description of Artificial Sequence: Synthetic peptide
GGSGGGGSG

SEQ ID NO: 548 - protein, 108 aa, Artificial Sequence; identical to SEQ ID NO: 31
  Description of Artificial Sequence: Synthetic polypeptide

SEQ ID NO: 549 - protein, 106 aa, Artificial Sequence
  Description of Artificial Sequence: Synthetic polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 550 - protein, 248 aa, Artificial Sequence
  Description of Artificial Sequence: Synthetic polypeptide
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSGGGGSGGGGSEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 551 - protein, 117 aa, Artificial Sequence; identical to SEQ ID NO: 59
  Description of Artificial Sequence: Synthetic polypeptide

SEQ ID NO: 552 - protein, 10 aa, Artificial Sequence
  Description of Artificial Sequence: Synthetic peptide
GGGGSGGGGS

SEQ ID NO: 553 - protein, 121 aa, Artificial Sequence; identical to SEQ ID NO: 30
  Description of Artificial Sequence: Synthetic polypeptide

SEQ ID NO: 554 - protein, 330 aa, Artificial Sequence; identical to SEQ ID NO: 544
  Description of Artificial Sequence: Synthetic polypeptide

SEQ ID NO: 555 - protein, 225 aa, Artificial Sequence
  Description of Artificial Sequence: Synthetic polypeptide
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRGGSGGGGSGDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 556 - protein, 108 aa, Artificial Sequence; identical to SEQ ID NO: 84
  Description of Artificial Sequence: Synthetic polypeptide

SEQ ID NO: 557 - protein, 9 aa, Artificial Sequence
  Description of Artificial Sequence: Synthetic peptide
GGSGGGGSG

SEQ ID NO: 558 - protein, 108 aa, Artificial Sequence; identical to SEQ ID NO: 31
  Description of Artificial Sequence: Synthetic polypeptide

SEQ ID NO: 559 - protein, 106 aa, Artificial Sequence; identical to SEQ ID NO: 549
  Description of Artificial Sequence: Synthetic polypeptide

SEQ ID NO: 560 - protein, 248 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWDSFYGMDYWGQGTTVTVSS

SEQ ID NO: 561 - protein, 117 aa, Artificial Sequence; identical to SEQ ID NO: 58
  Description of Artificial Sequence: Synthetic polypeptide

SEQ ID NO: 562 - protein, 10 aa, Artificial Sequence
  Description of Artificial Sequence: Synthetic peptide
GGGGSGGGGS

SEQ ID NO: 563 - protein, 121 aa, Artificial Sequence; identical to SEQ ID NO: 109
  Description of Artificial Sequence: Synthetic polypeptide

SEQ ID NO: 564 - protein, 330 aa, Artificial Sequence; identical to SEQ ID NO: 544
  Description of Artificial Sequence: Synthetic polypeptide

SEQ ID NO: 565 - protein, 225 aa, Artificial Sequence
  Description of Artificial Sequence: Synthetic polypeptide
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRGGSGGGGSGDIQMTQSPSSLSASVGDRVTITCSASSGSISYIDWFQQKPGKAPKRLIYATFELASGVPSRFSGSGSGTDFTLTISSLQPEDFATYYCHQLGSYPDTFGQGTKLEIKR

SEQ ID NO: 566 - protein, 108 aa, Artificial Sequence; identical to SEQ ID NO: 78
  Description of Artificial Sequence: Synthetic polypeptide

SEQ ID NO: 567 - protein, 9 aa, Artificial Sequence
  Description of Artificial Sequence: Synthetic peptide
GGSGGGGSG

SEQ ID NO: 568 - protein, 108 aa, Artificial Sequence
  Description of Artificial Sequence: Synthetic polypeptide
DIQMTQSPSSLSASVGDRVTITCSASSGSISYIDWFQQKPGKAPKRLIYATFELASGVPSRFSGSGSGTDFTLTISSLQPEDFATYYCHQLGSYPDTFGQGTKLEIKR

SEQ ID NO: 569 - protein, 106 aa, Artificial Sequence; identical to SEQ ID NO: 549
  Description of Artificial Sequence: Synthetic polypeptide

SEQ ID NO: 570 - protein, 248 aa, Artificial Sequence
  Description of Artificial Sequence: Synthetic polypeptide
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSGGGGSGGGGSEVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWDSFYGMDYWGQGTTVTVSS

SEQ ID NO: 571 - protein, 117 aa, Artificial Sequence; identical to SEQ ID NO: 59
  Description of Artificial Sequence: Synthetic polypeptide

SEQ ID NO: 572 - protein, 10 aa, Artificial Sequence
  Description of Artificial Sequence: Synthetic peptide
GGGGSGGGGS

SEQ ID NO: 573 - protein, 121 aa, Artificial Sequence; identical to SEQ ID NO: 109
  Description of Artificial Sequence: Synthetic polypeptide

SEQ ID NO: 574 - protein, 330 aa, Artificial Sequence; identical to SEQ ID NO: 544
  Description of Artificial Sequence: Synthetic polypeptide

SEQ ID NO: 575 - protein, 225 aa, Artificial Sequence
  Description of Artificial Sequence: Synthetic polypeptide
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRGGSGGGGSGDIQMTQSPSSLSASVGDRVTITCSASSGSISYIDWFQQKPGKAPKRLIYATFELASGVPSRFSGSGSGTDFTLTISSLQPEDFATYYCHQLGSYPDTFGQGTKLEIKR

SEQ ID NO: 576 - protein, 108 aa, Artificial Sequence; identical to SEQ ID NO: 84
  Description of Artificial Sequence: Synthetic polypeptide

SEQ ID NO: 577 - protein, 9 aa, Artificial Sequence
  Description of Artificial Sequence: Synthetic peptide
GGSGGGGSG

SEQ ID NO: 578 - protein, 108 aa, Artificial Sequence; identical to SEQ ID NO: 568
  Description of Artificial Sequence: Synthetic polypeptide

SEQ ID NO: 579 - protein, 106 aa, Artificial Sequence; identical to SEQ ID NO: 549
  Description of Artificial Sequence: Synthetic polypeptide

SEQ ID NO: 580 - protein, 248 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYDKWYSFEGMDIWGQGTTVTVSS

SEQ ID NO: 581 - protein, 117 aa, Artificial Sequence; identical to SEQ ID NO: 58
  Description of Artificial Sequence: Synthetic polypeptide

SEQ ID NO: 582 - protein, 10 aa, Artificial Sequence
  Description of Artificial Sequence: Synthetic peptide
GGGGSGGGGS

SEQ ID NO: 583 - protein, 121 aa, Artificial Sequence; identical to SEQ ID NO: 111
  Description of Artificial Sequence: Synthetic polypeptide

SEQ ID NO: 584 - protein, 330 aa, Artificial Sequence; identical to SEQ ID NO: 544
  Description of Artificial Sequence: Synthetic polypeptide

SEQ ID NO: 585 - protein, 225 aa, Artificial Sequence
  Description of Artificial Sequence: Synthetic polypeptide
DIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKRGGSGGGGSGDIQMTQSPSSLSASVGDRVTITCSASQGIRSYIDWFQQKPGKSPKRLIYATFDLASGVPSRFSGSGSGTDYTLTISSLQPEDFATYYCRQVGNYPGTFGQGTKLEIKR

SEQ ID NO: 586 - protein, 108 aa, Artificial Sequence; identical to SEQ ID NO: 78
  Description of Artificial Sequence: Synthetic polypeptide

SEQ ID NO: 587 - protein, 9 aa, Artificial Sequence
  Description of Artificial Sequence: Synthetic peptide
GGSGGGGSG

SEQ ID NO: 588 - protein, 108 aa, Artificial Sequence
  Description of Artificial Sequence: Synthetic polypeptide
DIQMTQSPSSLSASVGDRVTITCSASQGIRSYIDWFQQKPGKSPKRLIYATFDLASGVPSRFSGSGSGTDYTLTISSLQPEDFATYYCRQVGNYPGTFGQGTKLEIKR

SEQ ID NO: 589 - protein, 106 aa, Artificial Sequence; identical to SEQ ID NO: 549
  Description of Artificial Sequence: Synthetic polypeptide

SEQ ID NO: 590 - protein, 248 aa, Artificial Sequence
  Description of Artificial Sequence: Synthetic polypeptide
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSGGGGSGGGGSEVQLVQSGAEVKKPGSSVKVSCKASGYTFTDYEIHWVRQAPGQGLEWIGVNDPDSGGTLYNQKFDGRVTLTADESTSTAYMELSSLRSEDTAVYYCTRYDKWYSFEGMDIWGQGTTVTVSS

SEQ ID NO: 591 - protein, 117 aa, Artificial Sequence; identical to SEQ ID NO: 59
  Description of Artificial Sequence: Synthetic polypeptide

SEQ ID NO: 592 - protein, 10 aa, Artificial Sequence
  Description of Artificial Sequence: Synthetic peptide
GGGGSGGGGS

SEQ ID NO: 593 - protein, 121 aa, Artificial Sequence; identical to SEQ ID NO: 111
  Description of Artificial Sequence: Synthetic polypeptide

SEQ ID NO: 594 - protein, 330 aa, Artificial Sequence; identical to SEQ ID NO: 544
  Description of Artificial Sequence: Synthetic polypeptide

SEQ ID NO: 595 - protein, 225 aa, Artificial Sequence
  Description of Artificial Sequence: Synthetic polypeptide
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRGGSGGGGSGDIQMTQSPSSLSASVGDRVTITCSASQGIRSYIDWFQQKPGKSPKRLIYATFDLASGVPSRFSGSGSGTDYTLTISSLQPEDFATYYCRQVGNYPGTFGQGTKLEIKR

SEQ ID NO: 596 - protein, 108 aa, Artificial Sequence; identical to SEQ ID NO: 84
  Description of Artificial Sequence: Synthetic polypeptide

SEQ ID NO: 597 - protein, 9 aa, Artificial Sequence
  Description of Artificial Sequence: Synthetic peptide
GGSGGGGSG

SEQ ID NO: 598 - protein, 108 aa, Artificial Sequence; identical to SEQ ID NO: 588
  Description of Artificial Sequence: Synthetic polypeptide

SEQ ID NO: 599 - protein, 106 aa, Artificial Sequence; identical to SEQ ID NO: 549
  Description of Artificial Sequence: Synthetic polypeptide

SEQ ID NO: 600 - protein, 248 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWYSFEGMDIWGQGTTVTVSS

SEQ ID NO: 601 - protein, 117 aa, Artificial Sequence; identical to SEQ ID NO: 58
  Description of Artificial Sequence: Synthetic polypeptide

SEQ ID NO: 602 - protein, 10 aa, Artificial Sequence
  Description of Artificial Sequence: Synthetic peptide
GGGGSGGGGS

SEQ ID NO: 603 - protein, 121 aa, Artificial Sequence; identical to SEQ ID NO: 113
  Description of Artificial Sequence: Synthetic polypeptide

SEQ ID NO: 604 - protein, 330 aa, Artificial Sequence; identical to SEQ ID NO: 544
  Description of Artificial Sequence: Synthetic polypeptide

SEQ ID NO: 605 - protein, 248 aa, Artificial Sequence
  Description of Artificial Sequence: Synthetic polypeptide
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSGGGGSGGGGSEVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKWYSFEGMDIWGQGTTVTVSS

SEQ ID NO: 606 - protein, 117 aa, Artificial Sequence; identical to SEQ ID NO: 59
  Description of Artificial Sequence: Synthetic polypeptide

SEQ ID NO: 607 - protein, 10 aa, Artificial Sequence
  Description of Artificial Sequence: Synthetic peptide
GGGGSGGGGS

SEQ ID NO: 608 - protein, 121 aa, Artificial Sequence; identical to SEQ ID NO: 113
  Description of Artificial Sequence: Synthetic polypeptide

SEQ ID NO: 609 - protein, 330 aa, Artificial Sequence; identical to SEQ ID NO: 544
  Description of Artificial Sequence: Synthetic polypeptide

SEQ ID NO: 610 - protein, 248 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVQSGAEVKKPGSSVKVSCKASGYTFTDYEIHWVRQAPGQGLEWIGVNDPESGGTFYNQKFDGRVTLSADESTSTAYMELSSLRSEDTAVYYCTRYDKYWSFEGMDYWGQGTTVTVSS

SEQ ID NO: 611 - protein, 117 aa, Artificial Sequence; identical to SEQ ID NO: 58
  Description of Artificial Sequence: Synthetic polypeptide

SEQ ID NO: 612 - protein, 10 aa, Artificial Sequence
  Description of Artificial Sequence: Synthetic peptide
GGGGSGGGGS

SEQ ID NO: 613 - protein, 121 aa, Artificial Sequence; identical to SEQ ID NO: 112
  Description of Artificial Sequence: Synthetic polypeptide

SEQ ID NO: 614 - protein, 330 aa, Artificial Sequence; identical to SEQ ID NO: 544
  Description of Artificial Sequence: Synthetic polypeptide

SEQ ID NO: 615 - protein, 248 aa, Artificial Sequence
  Description of Artificial Sequence: Synthetic polypeptide
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSGGGGSGGGGSEVQLVQSGAEVKKPGSSVKVSCKASGYTFTDYEIHWVRQAPGQGLEWIGVNDPESGGTFYNQKFDGRVTLSADESTSTAYMELSSLRSEDTAVYYCTRYDKYWSFEGMDYWGQGTTVTVSS

SEQ ID NO: 616 - protein, 117 aa, Artificial Sequence; identical to SEQ ID NO: 59
  Description of Artificial Sequence: Synthetic polypeptide

SEQ ID NO: 617 - protein, 10 aa, Artificial Sequence
  Description of Artificial Sequence: Synthetic peptide
GGGGSGGGGS

SEQ ID NO: 618 - protein, 121 aa, Artificial Sequence; identical to SEQ ID NO: 112
  Description of Artificial Sequence: Synthetic polypeptide

SEQ ID NO: 619 - protein, 330 aa, Artificial Sequence; identical to SEQ ID NO: 544
  Description of Artificial Sequence: Synthetic polypeptide

SEQ ID NO: 620 - protein, 248 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKYWSFEGMDYWGQGTTVTVSS

SEQ ID NO: 621 - protein, 117 aa, Artificial Sequence; identical to SEQ ID NO: 58
  Description of Artificial Sequence: Synthetic polypeptide

SEQ ID NO: 622 - protein, 10 aa, Artificial Sequence
  Description of Artificial Sequence: Synthetic peptide
GGGGSGGGGS

SEQ ID NO: 623 - protein, 121 aa, Artificial Sequence; identical to SEQ ID NO: 114
  Description of Artificial Sequence: Synthetic polypeptide

SEQ ID NO: 624 - protein, 330 aa, Artificial Sequence; identical to SEQ ID NO: 544
  Description of Artificial Sequence: Synthetic polypeptide

SEQ ID NO: 625 - protein, 248 aa, Artificial Sequence
  Description of Artificial Sequence: Synthetic polypeptide
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSGGGGSGGGGSEVQLVQSGAEVKKPGSSVKVSCKASGYTFSDYEIHWVRQAPGQGLEWMGVNDPESGGTFYNQKFDGRVTLTADESTSTAYMELSSLRSEDTAVYYCTRYDKYWSFEGMDYWGQGTTVTVSS

SEQ ID NO: 626 - protein, 117 aa, Artificial Sequence; identical to SEQ ID NO: 59
  Description of Artificial Sequence: Synthetic polypeptide

SEQ ID NO: 627 - protein, 10 aa, Artificial Sequence
  Description of Artificial Sequence: Synthetic peptide
GGGGSGGGGS

SEQ ID NO: 628 - protein, 121 aa, Artificial Sequence; identical to SEQ ID NO: 114
  Description of Artificial Sequence: Synthetic polypeptide

SEQ ID NO: 629 - protein, 330 aa, Artificial Sequence; identical to SEQ ID NO: 544
  Description of Artificial Sequence: Synthetic polypeptide

SEQ ID NO: 630 - protein, 248 aa, Artificial Sequence
  Description of Artificial Sequence: Synthetic polypeptide
EVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSSGGGGSGGGGSEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKWYSFEGMDIWGQGTTVTVSS

SEQ ID NO: 631 - protein, 117 aa, Artificial Sequence; identical to SEQ ID NO: 58
  Description of Artificial Sequence: Synthetic polypeptide

SEQ ID NO: 632 - protein, 10 aa, Artificial Sequence
  Description of Artificial Sequence: Synthetic peptide
GGGGSGGGGS

SEQ ID NO: 633 - protein, 121 aa, Artificial Sequence; identical to SEQ ID NO: 115
  Description of Artificial Sequence: Synthetic polypeptide

SEQ ID NO: 634 - protein, 330 aa, Artificial Sequence; identical to SEQ ID NO: 544
  Description of Artificial Sequence: Synthetic polypeptide

SEQ ID NO: 635 - protein, 248 aa, Artificial Sequence
  Description of Artificial Sequence: Synthetic polypeptide
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSGGGGSGGGGSEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYDKWYSFEGMDIWGQGTTVTVSS

SEQ ID NO: 636 - protein, 117 aa, Artificial Sequence; identical to SEQ ID NO: 59
  Description of Artificial Sequence: Synthetic polypeptide

SEQ ID NO: 637 - protein, 10 aa, Artificial Sequence
  Description of Artificial Sequence: Synthetic peptide
GGGGSGGGGS

SEQ ID NO: 638 - protein, 121 aa, Artificial Sequence; identical to SEQ ID NO: 115
  Description of Artificial Sequence: Synthetic polypeptide

SEQ ID NO: 639 - protein, 330 aa, Artificial Sequence; identical to SEQ ID NO: 544
  Description of Artificial Sequence: Synthetic polypeptide

SEQ ID NO: 640 - protein, 248 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWDSFYGMDYWGQGTTVTVSSGGGGSGGGGSEVQLVESGGGLVQPGGSLRLSCAASGFTFSNYGVTWVRQAPGKGLEWVSMIWADGSTHYASSVKGRFTISRDNSKNTLYLQMNSLRAEDTAVYYCAREWQHGPVAYWGQGTLVTVSS

SEQ ID NO: 641 - protein, 121 aa, Artificial Sequence; identical to SEQ ID NO: 109
  Description of Artificial Sequence: Synthetic polypeptide

SEQ ID NO: 642 - protein, 10 aa, Artificial Sequence
  Description of Artificial Sequence: Synthetic peptide
GGGGSGGGGS

SEQ ID NO: 643 - protein, 117 aa, Artificial Sequence; identical to SEQ ID NO: 58
  Description of Artificial Sequence: Synthetic polypeptide

SEQ ID NO: 644 - protein, 330 aa, Artificial Sequence; identical to SEQ ID NO: 544
  Description of Artificial Sequence: Synthetic polypeptide

SEQ ID NO: 645 - protein, 225 aa, Artificial Sequence
  Description of Artificial Sequence: Synthetic polypeptide
DIQMTQSPSSLSASVGDRVTITCSASSGSISYIDWFQQKPGKAPKRLIYATFELASGVPSRFSGSGSGTDFTLTISSLQPEDFATYYCHQLGSYPDTFGQGTKLEIKRGGSGGGGSGDIQMTQSPSSLSASVGDRVTITCRASQLVSSAVAWYQQKPGKAPKLLIYWASARHTGVPSRFSGSGSGTDFTLTISSLQPEDFATYYCQQHYKTPFTFGQGTKLEIKR

SEQ ID NO: 646 - protein, 108 aa, Artificial Sequence; identical to SEQ ID NO: 568
  Description of Artificial Sequence: Synthetic polypeptide

SEQ ID NO: 647 - protein, 9 aa, Artificial Sequence
  Description of Artificial Sequence: Synthetic peptide
GGSGGGGSG

SEQ ID NO: 648 - protein, 108 aa, Artificial Sequence; identical to SEQ ID NO: 78
  Description of Artificial Sequence: Synthetic polypeptide

SEQ ID NO: 649 - protein, 106 aa, Artificial Sequence; identical to SEQ ID NO: 549
  Description of Artificial Sequence: Synthetic polypeptide

SEQ ID NO: 650 - protein, 248 aa, Artificial Sequence
  Description of Artificial Sequence: Synthetic polypeptide
EVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWDSFYGMDYWGQGTTVTVSSGGGGSGGGGSEVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSS

SEQ ID NO: 651 - protein, 121 aa, Artificial Sequence; identical to SEQ ID NO: 109
  Description of Artificial Sequence: Synthetic polypeptide

SEQ ID NO: 652 - protein, 10 aa, Artificial Sequence
  Description of Artificial Sequence: Synthetic peptide
GGGGSGGGGS

SEQ ID NO: 653 - protein, 117 aa, Artificial Sequence; identical to SEQ ID NO: 59
  Description of Artificial Sequence: Synthetic polypeptide

SEQ ID NO: 654 - protein, 330 aa, Artificial Sequence; identical to SEQ ID NO: 544
  Description of Artificial Sequence: Synthetic polypeptide

SEQ ID NO: 655 - protein, 225 aa, Artificial Sequence
  Description of Artificial Sequence: Synthetic polypeptide
DIQMTQSPSSLSASVGDRVTITCSASSGSISYIDWFQQKPGKAPKRLIYATFELASGVPSRFSGSGSGTDFTLTISSLQPEDFATYYCHQLGSYPDTFGQGTKLEIKRGGSGGGGSGDIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKR

SEQ ID NO: 656 - protein, 108 aa, Artificial Sequence; identical to SEQ ID NO: 568
  Description of Artificial Sequence: Synthetic polypeptide

SEQ ID NO: 657 - protein, 9 aa, Artificial Sequence
  Description of Artificial Sequence: Synthetic peptide
GGSGGGGSG

SEQ ID NO: 658 - protein, 108 aa, Artificial Sequence; identical to SEQ ID NO: 84
  Description of Artificial Sequence: Synthetic polypeptide

SEQ ID NO: 659 - protein, 106 aa, Artificial Sequence; identical to SEQ ID NO: 549
  Description of Artificial Sequence: Synthetic polypeptide

SEQ ID NO: 660 - protein, 255 aa, Artificial Sequence
  Description of Artificial Sequence: Synthetic polypeptide
EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSSGGGGSGGGGSEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 661 - protein, 124 aa, Artificial Sequence; identical to SEQ ID NO: 88
  Description of Artificial Sequence: Synthetic polypeptide

SEQ ID NO: 662 - protein, 10 aa, Artificial Sequence
  Description of Artificial Sequence: Synthetic peptide
GGGGSGGGGS

SEQ ID NO: 663 - protein, 121 aa, Artificial Sequence; identical to SEQ ID NO: 30
  Description of Artificial Sequence: Synthetic polypeptide

SEQ ID NO: 664 - protein, 330 aa, Artificial Sequence; identical to SEQ ID NO: 544
  Description of Artificial Sequence: Synthetic polypeptide

SEQ ID NO: 665 - protein, 225 aa, Artificial Sequence
  Description of Artificial Sequence: Synthetic polypeptide
DIQMTQSPSSLSASVGDRVTITCRASQDISQYLNWYQQKPGKAPKLLIYYTSRLQSGVPSRFSGSGSGTDFTLTISSLQPEDFATYFCQQGNTWPPTFGQGTKLEIKRGGSGGGGSGDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 666 - protein, 108 aa, Artificial Sequence
  Description of Artificial Sequence: Synthetic polypeptide
DIQMTQSPSSLSASVGDRVTITCRASQDISQYLNWYQQKPGKAPKLLIYYTSRLQSGVPSRFSGSGSGTDFTLTISSLQPEDFATYFCQQGNTWPPTFGQGTKLEIKR

SEQ ID NO: 667 - protein, 9 aa, Artificial Sequence
  Description of Artificial Sequence: Synthetic peptide
GGSGGGGSG

SEQ ID NO: 668 - protein, 108 aa, Artificial Sequence; identical to SEQ ID NO: 31
  Description of Artificial Sequence: Synthetic polypeptide

SEQ ID NO: 669 - protein, 106 aa, Artificial Sequence; identical to SEQ ID NO: 549
  Description of Artificial Sequence: Synthetic polypeptide

SEQ ID NO: 670 - protein, 255 aa, Artificial Sequence
  Description of Artificial Sequence: Synthetic polypeptide
EVQLVQSGAEVKKPGASVKVSCKASGYTFANYGIIWVRQAPGQGLEWMGWINTYTGKPTYAQKFQGRVTMTTDTSTSTAYMELSSLRSEDTAVYYCARKLFTTMDVTDNAMDYWGQGTTVTVSSGGGGSGGGGSEVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWDSFYGMDYWGQGTTVTVSS

SEQ ID NO: 671 - protein, 124 aa, Artificial Sequence; identical to SEQ ID NO: 88
  Description of Artificial Sequence: Synthetic polypeptide

SEQ ID NO: 672 - protein, 10 aa, Artificial Sequence
  Description of Artificial Sequence: Synthetic peptide
GGGGSGGGGS

SEQ ID NO: 673 - protein, 121 aa, Artificial Sequence; identical to SEQ ID NO: 109
  Description of Artificial Sequence: Synthetic polypeptide

SEQ ID NO: 674 - protein, 330 aa, Artificial Sequence; identical to SEQ ID NO: 544
  Description of Artificial Sequence: Synthetic polypeptide

SEQ ID NO: 675 - protein, 225 aa, Artificial Sequence
  Description of Artificial Sequence: Synthetic polypeptide
DIQMTQSPSSLSASVGDRVTITCRASQDISQYLNWYQQKPGKAPKLLIYYTSRLQSGVPSRFSGSGSGTDFTLTISSLQPEDFATYFCQQGNTWPPTFGQGTKLEIKRGGSGGGGSGDIQMTQSPSSLSASVGDRVTITCSASSGSISYIDWFQQKPGKAPKRLIYATFELASGVPSRFSGSGSGTDFTLTISSLQPEDFATYYCHQLGSYPDTFGQGTKLEIKR

SEQ ID NO: 676 - protein, 108 aa, Artificial Sequence; identical to SEQ ID NO: 666
  Description of Artificial Sequence: Synthetic polypeptide

SEQ ID NO: 677 - protein, 9 aa, Artificial Sequence
  Description of Artificial Sequence: Synthetic peptide
GGSGGGGSG

SEQ ID NO: 678 - protein, 108 aa, Artificial Sequence; identical to SEQ ID NO: 568
  Description of Artificial Sequence: Synthetic polypeptide

SEQ ID NO: 679 - protein, 106 aa, Artificial Sequence; identical to SEQ ID NO: 549
  Description of Artificial Sequence: Synthetic polypeptide

SEQ ID NO: 680 - protein, 255 aa, Artificial Sequence
  Description of Artificial Sequence: Synthetic polypeptide
EVQLVQSGAEVKKPGASVKVSCKASGYTFNNYGIIWVRQAPGQGLEWMGWINTYSGKPTYAQKFQGRVTMTTDTSTSTAYMELSSLRSEDTAVYFCARKLFTTMDVTDNAMDYWGQGTTVTVSSGGGGSGGGGSEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 681 - protein, 124 aa, Artificial Sequence; identical to SEQ ID NO: 97
  Description of Artificial Sequence: Synthetic polypeptide

SEQ ID NO: 682 - protein, 10 aa, Artificial Sequence
  Description of Artificial Sequence: Synthetic peptide
GGGGSGGGGS

SEQ ID NO: 683 - protein, 121 aa, Artificial Sequence; identical to SEQ ID NO: 30
  Description of Artificial Sequence: Synthetic polypeptide

SEQ ID NO: 684 - protein, 330 aa, Artificial Sequence; identical to SEQ ID NO: 544
  Description of Artificial Sequence: Synthetic polypeptide

SEQ ID NO: 685 - protein, 225 aa, Artificial Sequence
  Description of Artificial Sequence: Synthetic polypeptide
DIQMTQSPSSLSASVGDRVTITCRASQDISNFLNWYQQKPGKAPKLLIYYTSRLQSGVPSRFSGSGSGTDYTLTISSLQPEDFATYFCQQGNTQPPTFGQGTKLEIKRGGSGGGGSGDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 686 - protein, 108 aa, Artificial Sequence
  Description of Artificial Sequence: Synthetic polypeptide
DIQMTQSPSSLSASVGDRVTITCRASQDISNFLNWYQQKPGKAPKLLIYYTSRLQSGVPSRFSGSGSGTDYTLTISSLQPEDFATYFCQQGNTQPPTFGQGTKLEIKR

SEQ ID NO: 687 - protein, 9 aa, Artificial Sequence
  Description of Artificial Sequence: Synthetic peptide
GGSGGGGSG

SEQ ID NO: 688 - protein, 108 aa, Artificial Sequence; identical to SEQ ID NO: 31
  Description of Artificial Sequence: Synthetic polypeptide

SEQ ID NO: 689 - protein, 106 aa, Artificial Sequence; identical to SEQ ID NO: 549
  Description of Artificial Sequence: Synthetic polypeptide

SEQ ID NO: 690 - protein, 255 aa, Artificial Sequence
  Description of Artificial Sequence: Synthetic polypeptide
EVQLVQSGAEVKKPGASVKVSCKASGYTFNNYGIIWVRQAPGQGLEWMGWINTYSGKPTYAQKFQGRVTMTTDTSTSTAYMELSSLRSEDTAVYFCARKLFTTMDVTDNAMDYWGQGTTVTVSSGGGGSGGGGSEVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWDSFYGMDYWGQGTTVTVSS

SEQ ID NO: 691 - protein, 124 aa, Artificial Sequence; identical to SEQ ID NO: 97
  Description of Artificial Sequence: Synthetic polypeptide

SEQ ID NO: 692 - protein, 10 aa, Artificial Sequence
  Description of Artificial Sequence: Synthetic peptide
GGGGSGGGGS

SEQ ID NO: 693 - protein, 121 aa, Artificial Sequence; identical to SEQ ID NO: 109
  Description of Artificial Sequence: Synthetic polypeptide

SEQ ID NO: 694 - protein, 330 aa, Artificial Sequence; identical to SEQ ID NO: 544
  Description of Artificial Sequence: Synthetic polypeptide

SEQ ID NO: 695 - protein, 225 aa, Artificial Sequence
  Description of Artificial Sequence: Synthetic polypeptide
DIQMTQSPSSLSASVGDRVTITCRASQDISNFLNWYQQKPGKAPKLLIYYTSRLQSGVPSRFSGSGSGTDYTLTISSLQPEDFATYFCQQGNTQPPTFGQGTKLEIKRGGSGGGGSGDIQMTQSPSSLSASVGDRVTITCSASSGSISYIDWFQQKPGKAPKRLIYATFELASGVPSRFSGSGSGTDFTLTISSLQPEDFATYYCHQLGSYPDTFGQGTKLEIKR

SEQ ID NO: 696 - protein, 108 aa, Artificial Sequence; identical to SEQ ID NO: 686
  Description of Artificial Sequence: Synthetic polypeptide

SEQ ID NO: 697 - protein, 9 aa, Artificial Sequence
  Description of Artificial Sequence: Synthetic peptide
GGSGGGGSG

SEQ ID NO: 698 - protein, 108 aa, Artificial Sequence; identical to SEQ ID NO: 568
  Description of Artificial Sequence: Synthetic polypeptide

SEQ ID NO: 699 - protein, 106 aa, Artificial Sequence; identical to SEQ ID NO: 549
  Description of Artificial Sequence: Synthetic polypeptide

SEQ ID NO: 700 - protein, 255 aa, Artificial Sequence
  Description of Artificial Sequence: Synthetic polypeptide
EVQLVQSGAEVKKPGASVKVSCKASGYTFNNYGINWVRQAPGQGLEWMGWINTYTGKPTYAQKFQGRVTMTTDTSTSTAYMELSSLRSEDTAVYFCARKFRNTVAVTDYAMDYWGQGTTVTVSSGGGGSGGGGSEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 701 - protein, 124 aa, Artificial Sequence; identical to SEQ ID NO: 93
  Description of Artificial Sequence: Synthetic polypeptide

SEQ ID NO: 702 - protein, 10 aa, Artificial Sequence
  Description of Artificial Sequence: Synthetic peptide
GGGGSGGGGS

SEQ ID NO: 703 - protein, 121 aa, Artificial Sequence; identical to SEQ ID NO: 30
  Description of Artificial Sequence: Synthetic polypeptide

SEQ ID NO: 704 - protein, 330 aa, Artificial Sequence; identical to SEQ ID NO: 544
  Description of Artificial Sequence: Synthetic polypeptide

SEQ ID NO: 705 - protein, 225 aa, Artificial Sequence
  Description of Artificial Sequence: Synthetic polypeptide
DIQMTQSPSSLSASVGDRVTITCRASQDIYDVLNWYQQKPGKAPKLLIYYASRLQSGVPSRFSGSGSGTDFTLTISSLQPEDFATYYCQQGITLPPTFGQGTKLEIKRGGSGGGGSGDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 706 - protein, 108 aa, Artificial Sequence
  Description of Artificial Sequence: Synthetic polypeptide
DIQMTQSPSSLSASVGDRVTITCRASQDIYDVLNWYQQKPGKAPKLLIYYASRLQSGVPSRFSGSGSGTDFTLTISSLQPEDFATYYCQQGITLPPTFGQGTKLEIKR

SEQ ID NO: 707 - protein, 9 aa, Artificial Sequence
  Description of Artificial Sequence: Synthetic peptide
GGSGGGGSG

SEQ ID NO: 708 - protein, 108 aa, Artificial Sequence; identical to SEQ ID NO: 31
  Description of Artificial Sequence: Synthetic polypeptide

SEQ ID NO: 709 - protein, 106 aa, Artificial Sequence; identical to SEQ ID NO: 549
  Description of Artificial Sequence: Synthetic polypeptide

SEQ ID NO: 710 - protein, 255 aa, Artificial Sequence
  Description of Artificial Sequence: Synthetic polypeptide
EVQLVQSGAEVKKPGASVKVSCKASGYTFNNYGINWVRQAPGQGLEWMGWINTYTGKPTYAQKFQGRVTMTTDTSTSTAYMELSSLRSEDTAVYFCARKFRNTVAVTDYAMDYWGQGTTVTVSSGGGGSGGGGSEVQLVQSGAEVKKPGSSVKVSCKASGYTFDDYEIHWVRQAPGQGLEWIGVNDPESGGTFYNQKFDGRATLTADKSTSTAYMELSSLRSEDTAVYYCTRYDKWDSFYGMDYWGQGTTVTVSS

SEQ ID NO: 711 - protein, 124 aa, Artificial Sequence; identical to SEQ ID NO: 93
  Description of Artificial Sequence: Synthetic polypeptide

SEQ ID NO: 712 - protein, 10 aa, Artificial Sequence
  Description of Artificial Sequence: Synthetic peptide
GGGGSGGGGS

SEQ ID NO: 713 - protein, 121 aa, Artificial Sequence; identical to SEQ ID NO: 109
  Description of Artificial Sequence: Synthetic polypeptide

SEQ ID NO: 714 - protein, 330 aa, Artificial Sequence; identical to SEQ ID NO: 544
  Description of Artificial Sequence: Synthetic polypeptide

SEQ ID NO: 715 - protein, 225 aa, Artificial Sequence
  Description of Artificial Sequence: Synthetic polypeptide
DIQMTQSPSSLSASVGDRVTITCRASQDIYDVLNWYQQKPGKAPKLLIYYASRLQSGVPSRFSGSGSGTDFTLTISSLQPEDFATYYCQQGITLPPTFGQGTKLEIKRGGSGGGGSGDIQMTQSPSSLSASVGDRVTITCSASSGSISYIDWFQQKPGKAPKRLIYATFELASGVPSRFSGSGSGTDFTLTISSLQPEDFATYYCHQLGSYPDTFGQGTKLEIKR

SEQ ID NO: 716 - protein, 108 aa, Artificial Sequence; identical to SEQ ID NO: 706
  Description of Artificial Sequence: Synthetic polypeptide

SEQ ID NO: 717 - protein, 9 aa, Artificial Sequence
  Description of Artificial Sequence: Synthetic peptide
GGSGGGGSG

SEQ ID NO: 718 - protein, 108 aa, Artificial Sequence; identical to SEQ ID NO: 568
  Description of Artificial Sequence: Synthetic polypeptide

SEQ ID NO: 719 - protein, 106 aa, Artificial Sequence; identical to SEQ ID NO: 549
  Description of Artificial Sequence: Synthetic polypeptide

SEQ ID NO: 720 - protein, 255 aa, Artificial Sequence
  Description of Artificial Sequence: Synthetic polypeptide
EVQLVQSGAEVKKPGASVKVSCKASGYTFNNYGIIWVRQAPGQGLEWMGWINTYTGKPTYAQKFQGRVTMTTDTSTSTAYMELSSLRSEDTAVYYCARKLFNTVAVTDNAMDYWGQGTTVTVSSGGGGSGGGGSEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 721 - protein, 124 aa, Artificial Sequence; identical to SEQ ID NO: 91
  Description of Artificial Sequence: Synthetic polypeptide

SEQ ID NO: 722 - protein, 10 aa, Artificial Sequence
  Description of Artificial Sequence: Synthetic peptide
GGGGSGGGGS

SEQ ID NO: 723 - protein, 121 aa, Artificial Sequence; identical to SEQ ID NO: 30
  Description of Artificial Sequence: Synthetic polypeptide

SEQ ID NO: 724 - protein, 330 aa, Artificial Sequence; identical to SEQ ID NO: 544
  Description of Artificial Sequence: Synthetic polypeptide

SEQ ID NO: 725 - protein, 225 aa, Artificial Sequence
  Description of Artificial Sequence: Synthetic polypeptide
DIQMTQSPSSLSASVGDRVTITCRASQDIENYLNWYQQKPGKAPKLLIYYTSRLQSGVPSRFSGSGSGTDFTLTISSLQPEDFATYFCQQGNTQPPTFGQGTKLEIKRGGSGGGGSGDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 726 - protein, 108 aa, Artificial Sequence
  Description of Artificial Sequence: Synthetic polypeptide
DIQMTQSPSSLSASVGDRVTITCRASQDIENYLNWYQQKPGKAPKLLIYYTSRLQSGVPSRFSGSGSGTDFTLTISSLQPEDFATYFCQQGNTQPPTFGQGTKLEIKR

SEQ ID NO: 727 - protein, 9 aa, Artificial Sequence
  Description of Artificial Sequence: Synthetic peptide
GGSGGGGSG

SEQ ID NO: 728 - protein, 108 aa, Artificial Sequence; identical to SEQ ID NO: 31
  Description of Artificial Sequence: Synthetic polypeptide

SEQ ID NO: 729 - protein, 106 aa, Artificial Sequence; identical to SEQ ID NO: 549
  Description of Artificial Sequence: Synthetic polypeptide

SEQ ID NO: 730 - protein, 244 aa, Artificial Sequence
  Description of Artificial Sequence: Synthetic polypeptide
EVQLVESGGGLVQPGGSLRLSCAASGFTFSNYGVEWVRQAPGKGLEWVSGIWADGSTHYADTVKSRFTISRDNSKNTLYLQMNSLRAEDTAVYYCAREWQHGPVAYWGQGTLVTVSSASTKGPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 731 - protein, 117 aa, Artificial Sequence; identical to SEQ ID NO: 59
  Description of Artificial Sequence: Synthetic polypeptide

SEQ ID NO: 732 - protein, 6 aa, Artificial Sequence
  Description of Artificial Sequence: Synthetic peptide
ASTKGP

SEQ ID NO: 733 - protein, 121 aa, Artificial Sequence; identical to SEQ ID NO: 30
  Description of Artificial Sequence: Synthetic polypeptide

SEQ ID NO: 734 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 735 - protein, 221 aa, Artificial Sequence
  Description of Artificial Sequence: Synthetic polypeptide
DIQMTQSPSSLSASVGDRVTITCKASQLVSSAVAWYQQKPGKAPKLLIYWASTLHTGVPSRFSGSGSGTDFTLTISSLQPEDFATYYCQQHYRTPFTFGQGTKLEIKRTVAAPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 736 - protein, 108 aa, Artificial Sequence; identical to SEQ ID NO: 84
  Description of Artificial Sequence: Synthetic polypeptide

SEQ ID NO: 737 - protein, 5 aa, Artificial Sequence
  Description of Artificial Sequence: Synthetic peptide
TVAAP

SEQ ID NO: 738 - protein, 108 aa, Artificial Sequence; identical to SEQ ID NO: 31
  Description of Artificial Sequence: Synthetic polypeptide

SEQ ID NO: 739 - protein, 106 aa, Artificial Sequence; identical to SEQ ID NO: 549
  Description of Artificial Sequence: Synthetic polypeptide

SEQ ID NO: 740 - protein, 251 aa, Artificial Sequence
  Description of Artificial Sequence: Synthetic polypeptide
EVQLVQSGAEVKKPGASVKVSCKASGYTFNNYGIIWVRQAPGQGLEWMGWINTYTGKPTYAQKFQGRVTMTTDTSTSTAYMELSSLRSEDTAVYYCARKLFNTVAVTDNAMDYWGQGTTVTVSSASTKGPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 741 - protein, 124 aa, Artificial Sequence; identical to SEQ ID NO: 91
  Description of Artificial Sequence: Synthetic polypeptide

SEQ ID NO: 742 - protein, 6 aa, Artificial Sequence
  Description of Artificial Sequence: Synthetic peptide
ASTKGP

SEQ ID NO: 743 - protein, 121 aa, Artificial Sequence; identical to SEQ ID NO: 30
  Description of Artificial Sequence: Synthetic polypeptide

SEQ ID NO: 744 - protein, 330 aa, Artificial Sequence; identical to SEQ ID NO: 734
  Description of Artificial Sequence: Synthetic polypeptide

SEQ ID NO: 745 - protein, 221 aa, Artificial Sequence
  Description of Artificial Sequence: Synthetic polypeptide
DIQMTQSPSSLSASVGDRVTITCRASQDIENYLNWYQQKPGKAPKLLIYYTSRLQSGVPSRFSGSGSGTDFTLTISSLQPEDFATYFCQQGNTQPPTFGQGTKLEIKRTVAAPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 746 - protein, 108 aa, Artificial Sequence; identical to SEQ ID NO: 726
  Description of Artificial Sequence: Synthetic polypeptide

SEQ ID NO: 747 - protein, 9 aa, Artificial Sequence
  Description of Artificial Sequence: Synthetic peptide
GGSGGGGSG

SEQ ID NO: 748 - protein, 108 aa, Artificial Sequence; identical to SEQ ID NO: 31
  Description of Artificial Sequence: Synthetic polypeptide

SEQ ID NO: 749 - protein, 106 aa, Artificial Sequence; identical to SEQ ID NO: 549
  Description of Artificial Sequence: Synthetic polypeptide

SEQ ID NO: 750 - protein, 251 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPEVQLVQSGAEVKKPGASVKVSCKASGYTFNNYGIIWVRQAPGQGLEWMGWINTYTGKPTYAQKFQGRVTMTTDTSTSTAYMELSSLRSEDTAVYYCARKLFNTVAVTDNAMDYWGQGTTVTVSS

SEQ ID NO: 751 - protein, 121 aa, Artificial Sequence; identical to SEQ ID NO: 30
  Description of Artificial Sequence: Synthetic polypeptide

SEQ ID NO: 752 - protein, 6 aa, Artificial Sequence
  Description of Artificial Sequence: Synthetic peptide
ASTKGP

SEQ ID NO: 753 - protein, 124 aa, Artificial Sequence; identical to SEQ ID NO: 91
  Description of Artificial Sequence: Synthetic polypeptide

SEQ ID NO: 754 - protein, 330 aa, Artificial Sequence; identical to SEQ ID NO: 734
  Description of Artificial Sequence: Synthetic polypeptide

SEQ ID NO: 755 - protein, 221 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPDIQMTQSPSSLSASVGDRVTITCRASQDIENYLNWYQQKPGKAPKLLIYYTSRLQSGVPSRFSGSGSGTDFTLTISSLQPEDFATYFCQQGNTQPPTFGQGTKLEIKR

SEQ ID NO: 756 - protein, 108 aa, Artificial Sequence; identical to SEQ ID NO: 726
  Description of Artificial Sequence: Synthetic polypeptide

SEQ ID NO: 757 - protein, 5 aa, Artificial Sequence
  Description of Artificial Sequence: Synthetic peptide
TVAAP

SEQ ID NO: 758 - protein, 108 aa, Artificial Sequence; identical to SEQ ID NO: 726
  Description of Artificial Sequence: Synthetic polypeptide

SEQ ID NO: 759 - protein, 106 aa, Artificial Sequence; identical to SEQ ID NO: 549
  Description of Artificial Sequence: Synthetic polypeptide

SEQ ID NO: 760 - protein, 255 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSGGGGSGGGGSEVQLVQSGAEVKKPGASVKVSCKASGYTFNNYGIIWVRQAPGQGLEWMGWINTYTGKPTYAQKFQGRVTMTTDTSTSTAYMELSSLRSEDTAVYYCARKLFNTVAVTDNAMDYWGQGTTVTVSS

SEQ ID NO: 761 - protein, 121 aa, Artificial Sequence; identical to SEQ ID NO: 30
  Description of Artificial Sequence: Synthetic polypeptide

SEQ ID NO: 762 - protein, 10 aa, Artificial Sequence
  Description of Artificial Sequence: Synthetic peptide
GGGGSGGGGS

SEQ ID NO: 763 - protein, 124 aa, Artificial Sequence; identical to SEQ ID NO: 91
  Description of Artificial Sequence: Synthetic polypeptide

SEQ ID NO: 764 - protein, 330 aa, Artificial Sequence; identical to SEQ ID NO: 734
  Description of Artificial Sequence: Synthetic polypeptide

SEQ ID NO: 765 - protein, 225 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRGGSGGGGSGDIQMTQSPSSLSASVGDRVTITCRASQDIENYLNWYQQKPGKAPKLLIYYTSRLQSGVPSRFSGSGSGTDFTLTISSLQPEDFATYFCQQGNTQPPTFGQGTKLEIKR

SEQ ID NO: 766 - protein, 108 aa, Artificial Sequence; identical to SEQ ID NO: 31
  Description of Artificial Sequence: Synthetic polypeptide

SEQ ID NO: 767 - protein, 9 aa, Artificial Sequence
  Description of Artificial Sequence: Synthetic peptide
GGSGGGGSG

SEQ ID NO: 768 - protein, 108 aa, Artificial Sequence; identical to SEQ ID NO: 726
  Description of Artificial Sequence: Synthetic polypeptide

SEQ ID NO: 769 - protein, 106 aa, Artificial Sequence; identical to SEQ ID NO: 549
  Description of Artificial Sequence: Synthetic polypeptide

SEQ ID NO: 770 - protein, 255 aa, Artificial Sequence; identical to SEQ ID NO: 660
  Description of Artificial Sequence: Synthetic polypeptide

SEQ ID NO: 771 - protein, 124 aa, Artificial Sequence; identical to SEQ ID NO: 88
  Description of Artificial Sequence: Synthetic polypeptide

SEQ ID NO: 772 - protein, 10 aa, Artificial Sequence
  Description of Artificial Sequence: Synthetic peptide
GGGGSGGGGS

SEQ ID NO: 773 - protein, 121 aa, Artificial Sequence; identical to SEQ ID NO: 30
  Description of Artificial Sequence: Synthetic polypeptide

SEQ ID NO: 774 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDQLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 775 - protein, 255 aa, Artificial Sequence; identical to SEQ ID NO: 660
  Description of Artificial Sequence: Synthetic polypeptide

SEQ ID NO: 776 - protein, 124 aa, Artificial Sequence; identical to SEQ ID NO: 88
  Description of Artificial Sequence: Synthetic polypeptide

SEQ ID NO: 777 - protein, 10 aa, Artificial Sequence
  Description of Artificial Sequence: Synthetic peptide
GGGGSGGGGS

SEQ ID NO: 778 - protein, 121 aa, Artificial Sequence; identical to SEQ ID NO: 30
  Description of Artificial Sequence: Synthetic polypeptide

SEQ ID NO: 779 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 780 - protein, 255 aa, Artificial Sequence; identical to SEQ ID NO: 670
  Description of Artificial Sequence: Synthetic polypeptide

SEQ ID NO: 781 - protein, 124 aa, Artificial Sequence; identical to SEQ ID NO: 88
  Description of Artificial Sequence: Synthetic polypeptide

SEQ ID NO: 782 - protein, 10 aa, Artificial Sequence
  Description of Artificial Sequence: Synthetic peptide
GGGGSGGGGS

SEQ ID NO: 783 - protein, 121 aa, Artificial Sequence; identical to SEQ ID NO: 109
  Description of Artificial Sequence: Synthetic polypeptide

SEQ ID NO: 784 - protein, 330 aa, Artificial Sequence; identical to SEQ ID NO: 774
  Description of Artificial Sequence: Synthetic polypeptide

SEQ ID NO: 785 - protein, 255 aa, Artificial Sequence; identical to SEQ ID NO: 660
  Description of Artificial Sequence: Synthetic polypeptide

SEQ ID NO: 786 - protein, 124 aa, Artificial Sequence; identical to SEQ ID NO: 88
  Description of Artificial Sequence: Synthetic polypeptide

SEQ ID NO: 787 - protein, 10 aa, Artificial Sequence
  Description of Artificial Sequence: Synthetic peptide
GGGGSGGGGS

SEQ ID NO: 788 - protein, 121 aa, Artificial Sequence; identical to SEQ ID NO: 30
  Description of Artificial Sequence: Synthetic polypeptide

SEQ ID NO: 789 - protein, 330 aa, Artificial Sequence; identical to SEQ ID NO: 734
  Description of Artificial Sequence: Synthetic polypeptide

SEQ ID NO: 790 - protein, 255 aa, Artificial Sequence; identical to SEQ ID NO: 720
  Description of Artificial Sequence: Synthetic polypeptide

SEQ ID NO: 791 - protein, 124 aa, Artificial Sequence; identical to SEQ ID NO: 91
  Description of Artificial Sequence: Synthetic polypeptide

SEQ ID NO: 792 - protein, 10 aa, Artificial Sequence
  Description of Artificial Sequence: Synthetic peptide
GGGGSGGGGS

SEQ ID NO: 793 - protein, 121 aa, Artificial Sequence; identical to SEQ ID NO: 30
  Description of Artificial Sequence: Synthetic polypeptide

SEQ ID NO: 794 - protein, 330 aa, Artificial Sequence; identical to SEQ ID NO: 734
  Description of Artificial Sequence: Synthetic polypeptide

SEQ ID NO: 795 - protein, 248 aa, Artificial Sequence; identical to SEQ ID NO: 540
  Description of Artificial Sequence: Synthetic polypeptide

SEQ ID NO: 796 - protein, 117 aa, Artificial Sequence; identical to SEQ ID NO: 58
  Description of Artificial Sequence: Synthetic polypeptide

SEQ ID NO: 797 - protein, 10 aa, Artificial Sequence
  Description of Artificial Sequence: Synthetic peptide
GGGGSGGGGS

SEQ ID NO: 798 - protein, 121 aa, Artificial Sequence; identical to SEQ ID NO: 30
  Description of Artificial Sequence: Synthetic polypeptide

SEQ ID NO: 799 - protein, 330 aa, Artificial Sequence; identical to SEQ ID NO: 734
  Description of Artificial Sequence: Synthetic polypeptide

SEQ ID NO: 800 - protein, 248 aa, Artificial Sequence; identical to SEQ ID NO: 550
  Description of Artificial Sequence: Synthetic polypeptide

SEQ ID NO: 801 - protein, 117 aa, Artificial Sequence; identical to SEQ ID NO: 59
  Description of Artificial Sequence: Synthetic polypeptide

SEQ ID NO: 802 - protein, 10 aa, Artificial Sequence
  Description of Artificial Sequence: Synthetic peptide
GGGGSGGGGS

SEQ ID NO: 803 - protein, 121 aa, Artificial Sequence; identical to SEQ ID NO: 30
  Description of Artificial Sequence: Synthetic polypeptide

SEQ ID NO: 804 - protein, 330 aa, Artificial Sequence; identical to SEQ ID NO: 734
  Description of Artificial Sequence: Synthetic polypeptide

SEQ ID NO: 805 - protein, 120 aa, Artificial Sequence
  Description of Artificial Sequence: Synthetic polypeptide
  MOD_RES (18)..(18): Ala or Val
  MOD_RES (30)..(30): Ser, Asn, Thr, Gly or Ala
  MOD_RES (31)..(31): Ser, Trp, Tyr, Ile, Asn, Phe, Arg or Leu
  MOD_RES (33)..(33): Ala, Thr, Ser, Pro or Gly
  MOD_RES (34)..(34): Ile, Thr or Val
  MOD_RES (35)..(35): Ser or Thr
  MOD_RES (50)..(50): Gly or Trp
  MOD_RES (51)..(51): Ile, Thr, Met, Leu, Val or Asn
  MOD_RES (55)..(55): Leu, Phe, Thr or Ile
  MOD_RES (56)..(56): Gly, Arg or Asp
  MOD_RES (57)..(57): Thr, Ser, Ala, Asn, Pro, Ile, Val, Lys or Phe
  MOD_RES (58)..(58): Ala, Pro, Ser or Gly
  MOD_RES (59)..(59): Asn, Ile, Thr, Ser, Val, His, Ala, Arg, Met or Leu
  MOD_RES (65)..(65): Leu or Gln
  MOD_RES (79)..(79): Val or Ala
  MOD_RES (99)..(99): Gly, Ser, Trp, Thr or Ala
  MOD_RES (100)..(100): Leu, Val, Ile, Phe, Arg or Gln
  MOD_RES (101)..(101): Tyr, Phe, Val, Pro or His
  MOD_RES (102)..(102): Tyr, Phe or Val
  MOD_RES (103)..(103): Asp, Asn, Glu, Thr, Ile or Ala
  MOD_RES (104)..(104): Pro, Thr, Phe, Arg, Gly or Asp
  MOD_RES (105)..(105): Thr, Ser, Ala, Lys, Arg, Ile, Tyr, Val, Pro, Asn or Gly
  MOD_RES (106)..(106): Arg, Trp, Ser, Pro or Ala
  MOD_RES (107)..(107): Ala, Phe or Met
EVQLVQSGAEVKKPGSSXKVSCKASGGTFXXYXXXWVRQAPGQGLEWMGXXIPIXXXXXYAQKFXGRVTITADESTSTXYMELSSLRSEDTAVYYCARXXXXXXXXXDYWGQGTLVTVSS

SEQ ID NO: 806 - protein, 108 aa, Artificial Sequence
  Description of Artificial Sequence: Synthetic polypeptide
  MOD_RES (1)..(1): Asp or Glu
  MOD_RES (4)..(4): Met or Leu
  MOD_RES (11)..(11): His or Gln
  MOD_RES (28)..(28): Ser, Arg, Thr, Asn, Ile, Cys, Gly, Lys, Tyr or Trp
  MOD_RES (31)..(31): Ser, Arg, Thr, Gly, Asn, Lys, Cys, His, Val, Pro or Leu
  MOD_RES (32)..(32): Ser, Arg, Thr, Asn, Cys, Gly, Ile, Lys, Met, Leu, Tyr, Pro or Val
  MOD_RES (49)..(49): Arg or Lys
  MOD_RES (50)..(50): His or Tyr
  MOD_RES (51)..(51): Ala, Val, Pro, Thr, Gly, Ser, Glu or Asp
  MOD_RES (55)..(55): Ile, Leu, Val, Thr, Ser, Met, Asn, Lys, Phe or Arg
  MOD_RES (76)..(76): His or Asn
  MOD_RES (91)..(91): Ser, Arg, Asn, Gly, Thr, Cys or Ile
  MOD_RES (92)..(92): Ser, Arg, Gly, Ile, Cys, Asn, Thr or Met
  MOD_RES (93)..(93): Ser, Arg, Ile, Cys, Gly, Asn, Thr or Lys
  MOD_RES (94)..(94): Ser or Leu
  MOD_RES (96)..(96): Pro, Leu, Ala, Ser, Arg, Thr, Gln or His
  MOD_RES (97)..(97): Pro, Ser, Arg, Leu, Thr, Ala, Gln, His, Val or Met
  MOD_RES (104)..(104): Gln or Lys
XIVXTQSPDFXSVTPKEKVTITCRASQXIGXXLHWYQQKPDQSPKLLIXXXSQSXSGVPSRFSGSGSGTDFTLTIXSLEAEDAATYYCHQXXXXPXXTFGQGTXVEIK

SEQ ID NO: 807 - protein, 117 aa, Artificial Sequence
  Description of Artificial Sequence: Synthetic polypeptide
  MOD_RES (31)..(31): Asp, Asn, His, Tyr or Ile
  MOD_RES (32)..(32): Tyr, Phe, Leu, Ser or Arg
  MOD_RES (33)..(33): Gly, Ser or Asn
  MOD_RES (35)..(35): Asn, Thr, Ser, His, Gln or Tyr
  MOD_RES (50)..(50): Met, Ile, Val, Leu, Arg, Lys or Ser
  MOD_RES (52)..(52): Trp, Arg, Gly, Ser, Ala or Leu
  MOD_RES (53)..(53): Gly, Ala, Ser, Asp, Glu, Val or Asn
  MOD_RES (54)..(54): Asp, Gly, Glu, Ala, Val, Gly or Tyr
  MOD_RES (56)..(56): Ser, Thr, Phe, Ala, Tyr or Trp
  MOD_RES (58)..(58): Asp, Ala, His, Val, Ser, Asn or Gly
  MOD_RES (60)..(60): Asp or Ala
  MOD_RES (61)..(61): Ser or Asp
  MOD_RES (62)..(62): Thr or Ser
  MOD_RES (63)..(63): Leu or Val
  MOD_RES (65)..(65): Ser or Gly
  MOD_RES (98)..(98): Glu, His, Gln, Leu, Tyr, Asp, Asn, Thr, Pro, Ala, Ser or Arg
  MOD_RES (99)..(99): Trp, Ser, Leu, Cys, Arg, Phe, Asp, Tyr, Pro, Ile or Gly
  MOD_RES (100)..(100): His, Gln, Arg, Leu, Tyr, Pro, Ala, Val, Asp or Cys
  MOD_RES (101)..(101): His, Gln, Pro, Leu, Asn, Tyr, Arg, Thr, Asp, Ala or Cys
  MOD_RES (102)..(102): Gly, Arg, Ala, Val, Trp, Glu, Ser, Pro or Ile
  MOD_RES (103)..(103): Pro, Thr, Ser, Gln, Ala or Lys
  MOD_RES (104)..(104): Val, Leu, Gly, Asp, Glu, Trp, Arg, Pro, Ala or Ile
  MOD_RES (105)..(105): Ala, Asp, Val, Gly or Thr
  MOD_RES (106)..(106): Tyr, Ser, Phe, Cys, Asn, Pro, Ile or His
EVQLVESGGGLVQPGGSLRLSCAASGFTFSXXXVXWVRQAPGKGLEWVSXIXXXGXTXYXXXXKXRFTISRDNSKNTLYLQMNSLRAEDTAVYYCARXXXXXXXXXWGQGTLVTVSS

SEQ ID NO: 808 - protein, 107 aa, Artificial Sequence
  Description of Artificial Sequence: Synthetic polypeptide
  MOD_RES (24)..(24): Lys or Arg
  MOD_RES (28)..(28): Ala, Ser, Val, Gly, Asp, Thr or Pro
  MOD_RES (30)..(30): Ser, Arg, Thr, Ile, Asn, Cys or Lys
  MOD_RES (31)..(31): Ser, Arg, Asn, Gly, Cys, Thr or Ile
  MOD_RES (32)..(32): Ala, Pro, Thr, Gly, Val, Ser or Arg
  MOD_RES (33)..(33): Val or Leu
  MOD_RES (50)..(50): Trp, Ser, Arg, Leu, Cys, Gln or Gly
  MOD_RES (53)..(53): Thr, Ser, Ile, Leu, Lys, Ala or Arg
  MOD_RES (54)..(54): Arg or Leu
  MOD_RES (55)..(55): His, Gln, Thr, Ala, Glu or Phe
  MOD_RES (56)..(56): Thr or Ser
  MOD_RES (91)..(91): His or Ser
  MOD_RES (92)..(92): Tyr, Asn, Phe, Asp, Gly or His
  MOD_RES (93)..(93): Ser, Arg, Gly, Thr, Ile or Cys
  MOD_RES (94)..(94): Thr, Ser, Pro, Met, Ile or Ala
  MOD_RES (95)..(95): Pro, Thr, Arg, Leu, Gln, Ala or Ser
  MOD_RES (96)..(96): Phe or Tyr
DIQMTQSPSSLSASVGDRVTITCXASQXVXXXXAWYQQKPGKAPKLLIYXASXXXXGVPSRFSGSGSGTDFTLTISSLQPEDFATYYCQQXXXXXXTFGQGTKLEIK

SEQ ID NO: 809 - protein, 124 aa, Artificial Sequence
  Description of Artificial Sequence: Synthetic polypeptide
  MOD_RES (2)..(2): Ile or Val
  MOD_RES (30)..(30): Thr, Asn, Ala, Ser, Arg, Asp, Lys, Pro, Gln, Met, Gly or Glu
  MOD_RES (31)..(31): Asn, Asp, His, Thr, Ser, Gln or Lys
  MOD_RES (34)..(34): Met or Ile
  MOD_RES (35)..(35): Asn, Ile, Thr, Gln, Ser, Gly, Ala or Val
  MOD_RES (55)..(55): Thr, Asn or Ser
  MOD_RES (57)..(57): Glu, Lys, Val, Gln, Arg, Leu, Ser, Asn, Ile, Asp or Ala
  MOD_RES (59)..(59): Thr, Ser, His, Asn, Met, Lys, Ala, Arg, Gln or Asp
  MOD_RES (62)..(62): Asp or Gln
  MOD_RES (63)..(63): Asp, Gly or Lys
  MOD_RES (64)..(64): Phe or Leu
  MOD_RES (65)..(65): Lys, Thr or Gln
  MOD_RES (68)..(68): Phe or Val
  MOD_RES (70)..(70): Phe or Met
  MOD_RES (72)..(72): Leu or Thr
  MOD_RES (95)..(95): Phe or Tyr
  MOD_RES (99)..(99): Lys, Arg or Asn
  MOD_RES (100)..(100): Phe, Leu, Tyr, Ile, Val or Cys
  MOD_RES (101)..(101): Leu, Phe, Met, Arg, Ser, Trp, Gln, Val, Asn, Gly or Cys
  MOD_RES (102)..(102): Thr, Asn, Lys, Ser, Arg, Leu, Pro, Phe, Asp, Met or Ala
  MOD_RES (103)..(103): Thr, Pro, Val, Ser or Ala
  MOD_RES (104)..(104): Val, Met, Glu, Ala, Arg, Ile, Gln, Gly or Asp
  MOD_RES (105)..(105): Val, Asp, Ala, Glu, Ser, Met, Ile or Pro
  MOD_RES (106)..(106): Val, Ala, Glu, Met, Asp, Gly, Ile, Gln, Pro, Asn, Leu or His
  MOD_RES (107)..(107): Thr, Ser, Met or Asn
  MOD_RES (108)..(108): Asp or Glu
  MOD_RES (109)..(109): Tyr, Asn, Ser, Cys, His, Asp, Ile, Phe, Val, Leu or Ala
  MOD_RES (110)..(110): Ala, Thr, Arg or Cys
EXQLVQSGAEVKKPGASVKVSCKASGYTFXXYGXXWVRQAPGQGLEWMGWINTYXGXPXYAXXXXGRXTXTXDTSTSTAYMELSSLRSEDTAVYXCARXXXXXXXXXXXXMDYWGQGTTVTVSS

SEQ ID NO: 810 - protein, 107 aa, Artificial Sequence
  Description of Artificial Sequence: Synthetic polypeptide
  MOD_RES (28)..(28): Asp, Asn, Glu, His, Gly, Val, Arg or Ala
  MOD_RES (30)..(30): Ser, Tyr, Glu, Ala, Thr, Trp, Gly, Asn, Phe or Cys
  MOD_RES (31)..(31): Asn, Gln, Ser, Lys, Thr, His, Asp or Arg
  MOD_RES (32)..(32): Tyr, Val, Phe or Thr
  MOD_RES (43)..(43): Thr, Ala or Val
  MOD_RES (44)..(44): Val or Pro
  MOD_RES (50)..(50): Tyr, Phe or Asn
  MOD_RES (51)..(51): Thr or Ala
  MOD_RES (53)..(53): Arg, Leu, Lys or Gly
  MOD_RES (71)..(71): Tyr or Phe
  MOD_RES (87)..(87): Phe or Tyr
  MOD_RES (92)..(92): Asn or Ile
  MOD_RES (93)..(93): Thr, Ser, Met, Ile, Ala or Arg
  MOD_RES (94)..(94): Leu, Trp, Gln, Pro, Met, Arg, Phe, Gly, Val, Tyr or Ala
  MOD_RES (96)..(96): Pro, Thr, Ser or Ala
DIQMTQSPSSLSASVGDRVTITCRASQXIXXXLNWYQQKPGKXXKLLIYXXSXLQSGVPSRFSGSGSGTDXTLTISSLQPEDFATYXCQQGXXXPXTFGQGTKLEIK

SEQ ID NO: 811 - protein, 121 aa, Artificial Sequence
  Description of Artificial Sequence: Synthetic polypeptide
  MOD_RES (30)..(30): Thr, Asp, Ser, Ala, Glu, Asn or Pro
  MOD_RES (31)..(31): Asp or Glu
  MOD_RES (48)..(48): Ile or Met
  MOD_RES (51)..(51): Asn or Ile
  MOD_RES (54)..(54): Glu or Asp
  MOD_RES (58)..(58): Thr, Ser or Ile
  MOD_RES (59)..(59): Phe, Leu, Tyr or Met
  MOD_RES (68)..(68): Ala, Val or Ile
  MOD_RES (70)..(70): Leu or Ile
  MOD_RES (100)..(100): Tyr, Asp, Ser, Trp, Phe, Glu or Asn
  MOD_RES (101)..(101): Arg, Lys or Met
  MOD_RES (102)..(102): Tyr, Trp or Phe
  MOD_RES (103)..(103): Glu, Asp, Trp, Tyr, Val, Asn, Met or Phe
  MOD_RES (104)..(104): Ser or Gly
  MOD_RES (105)..(105): Phe, Leu, Tyr or Ser
  MOD_RES (106)..(106): Tyr, Glu, Asn, Asp, Leu, Ser, Gln, Ala, Arg, Phe, Met, Lys or His
  MOD_RES (110)..(110): Tyr, Ile, Cys, Glu, Leu, Ser, Phe, His or Ala
EVQLVQSGAEVKKPGSSVKVSCKASGYTFXXYEIHWVRQAPGQGLEWXGVXDPXSGGXXYNQKFDGRXTXTADKSTSTAYMELSSLRSEDTAVYYCTRYXXXXXXXGMDXWGQGTTVTVSS

SEQ ID NO: 812 - protein, 107 aa, Artificial Sequence
  Description of Artificial Sequence: Synthetic polypeptide
  MOD_RES (4)..(4): Leu or Met
  MOD_RES (24)..(24): Ser, Arg or Lys
  MOD_RES (27)..(27): Ser or Gln
  MOD_RES (28)..(28): Gly, Ser, Asp, Gln, Ala, Ile, Val, Thr, Glu or absent
  MOD_RES (29)..(29): Ser, Ile, Val or Leu
  MOD_RES (30)..(30): Ile, Arg, Ser, Val, Asn, Phe, Gly, Leu, Pro, Lys or Met
  MOD_RES (31)..(31): Ser, Arg, Asn, Gly, Thr, Pro, Leu, Asp or Cys
  MOD_RES (32)..(32): Tyr, Cys, Ser, Asp, Asn, Pro, Ile, Phe or Ala
  MOD_RES (33)..(33): Ile, Leu or Val
  MOD_RES (34)..(34): Tyr, Asp, Asn, Phe, Ser, Gln or Gly
  MOD_RES (36)..(36): Phe or Tyr
  MOD_RES (43)..(43): Ser or Ala
  MOD_RES (47)..(47): Trp or Leu
  MOD_RES (50)..(50): Ala, Arg, Glu, Asp, Ser, Gly, Thr, Gln, Pro or Met
  MOD_RES (52)..(52): Phe or Ser
  MOD_RES (53)..(53): Glu, Asp, Ala, Tyr, Gly, Gln, Trp, Leu or His
  MOD_RES (55)..(55): Ala or Gln
  MOD_RES (89)..(89): His, Arg, Gln, Leu, Asn, Tyr, Ser, Val or Ala
  MOD_RES (91)..(91): Arg, Val, Trp, Leu, Met, Lys, Phe, Pro, Gly, Ser, Gln, Ile, Thr or Asp
  MOD_RES (92)..(92): Ser, Gly, Thr, Met, Asn, Arg, Lys, Ala or Asp
  MOD_RES (93)..(93): Ser, Asn, Ile, Arg, Phe, Thr, Tyr, Leu, Met, Trp, Lys, His or Gly
  MOD_RES (96)..(96): Trp, Glu, Leu, Gly, Phe, Tyr, Pro, Ile, Asp, Arg, His, Gln, Asn or Cys
DIQXTQSPSSLSASVGDRVTITCXASXXXXXXXXWXQQKPGKXPKRXIYXTXXLXSGVPSRFSGSGSGTDYTLTISSLQPEDFATYYCXQXXXYPXTFGQGTKLEIK

SEQ ID NO: 813 - protein, 5 aa, Artificial Sequence
  Description of Artificial Sequence: Synthetic peptide
NYGII

SEQ ID NO: 814 - protein, 17 aa, Artificial Sequence
  Description of Artificial Sequence: Synthetic peptide
WINTYTGKPTYAQKFQG

SEQ ID NO: 815 - protein, 15 aa, Artificial Sequence
  Description of Artificial Sequence: Synthetic peptide
KLFTTMDVTDNAMDY

SEQ ID NO: 816 - protein, 11 aa, Artificial Sequence
  Description of Artificial Sequence: Synthetic peptide
RASQDISQYLN

SEQ ID NO: 817 - protein, 7 aa, Artificial Sequence
  Description of Artificial Sequence: Synthetic peptide
YTSRLQS

SEQ ID NO: 818 - protein, 9 aa, Artificial Sequence
  Description of Artificial Sequence: Synthetic peptide
QQGNTWPPT

SEQ ID NO: 819 - protein, 5 aa, Artificial Sequence
  Description of Artificial Sequence: Synthetic peptide
DYEIH

SEQ ID NO: 820 - protein, 17 aa, Artificial Sequence
  Description of Artificial Sequence: Synthetic peptide
VNDPESGGTFYNQKFDG

SEQ ID NO: 821 - protein, 12 aa, Artificial Sequence
  Description of Artificial Sequence: Synthetic peptide
YSKWDSFDGMDY

SEQ ID NO: 822 - protein, 11 aa, Artificial Sequence
  Description of Artificial Sequence: Synthetic peptide
RASSGIISYID

SEQ ID NO: 823 - protein, 7 aa, Artificial Sequence
  Description of Artificial Sequence: Synthetic peptide
ATFDLAS

SEQ ID NO: 824 - protein, 9 aa, Artificial Sequence
  Description of Artificial Sequence: Synthetic peptide
RQVGSYPET

We claim:

1. A binding protein that specifically binds TNF-α and IL-17, and comprises a first polypeptide chain and a second polypeptide chain, wherein the first polypeptide chain comprises VD1-(X1)n-VD2-C-(X2)n, wherein
   VD1 is a first antibody heavy chain variable domain;
   VD2 is a second antibody heavy chain variable domain;
   C is a heavy chain constant domain;
   X1 is a linker with the proviso that it is not CH1;
   X2 is an Fc region; and
   n is 0 or 1;
   wherein the VD1 or VD2 of the first polypeptide chain is a heavy chain variable domain that binds TNF-α and comprises
   a CDR-H1 comprising the amino acid sequence NYGII (SEQ ID NO: 813),
   a CDR-H2 comprising the amino acid sequence WINTYTGKPTYAQKFQG (SEQ ID NO: 814), and
   a CDR-H3 comprising the amino acid sequence KLFTTMDVTDNAMDY (SEQ ID NO: 815);
   and wherein the second polypeptide chain comprises VD1-(X1)n-VD2-C-(X2)n, wherein
   VD1 is a first antibody light chain variable domain;
   VD2 is a second antibody light chain variable domain;
   C is a light chain constant domain;
   X1 is a linker with the proviso that it is not a light chain constant domain;
   X2 does not comprise an Fc region; and
   n is 0 or 1;
   wherein, the VD1 or VD2 of the second polypeptide chain is a light chain variable domain that binds TNF-α and comprises
   a CDR-L1 comprising the amino acid sequence RASQDISQYLN (SEQ ID NO: 816),
   a CDR-L2 comprising the amino acid sequence YTSRLQS (SEQ ID NO: 817), and
   a CDR-L3 comprising the amino acid sequence QQGNTWPPT (SEQ ID NO: 818); wherein both VD1s bind one target protein and both VD2s bind the other target protein.

2. The binding protein of claim 1, wherein the VD1 or VD2 of the first polypeptide chain comprises the amino acid sequence of SEQ ID NO: 661 and the VD1 or VD2 of the second polypeptide chain comprises the amino acid sequence of SEQ ID NO: 666.

3. A binding protein that specifically binds TNF-α and IL-17, and comprises a first and a second polypeptide chain, wherein the first polypeptide chain comprises VD1-(X1)n-VD2-C-(X2) n, wherein
   VD1 is a first antibody heavy chain variable domain;
   VD2 is a second antibody heavy chain variable domain;
   C is a heavy chain constant domain;
   X1 is a first linker with the proviso that it is not CH1;
   X2 is an Fc region; and
   n is 0 or 1; and
   wherein the second polypeptide chain comprises a second VD1-(X1)n-VD2-C-(X2)n, wherein
   VD1 is a first antibody light chain variable domain;

VD2 is a second antibody light chain variable domain;
C is a light chain constant domain;
X1 is a second linker with the proviso that it is not a light chain constant domain;
X2 does not comprise an Fc region; and
n is 0 or 1; and
wherein each of the VD1 and VD2 of the first polypeptide chain is a heavy chain variable domain that binds TNF-α or IL-17 and comprises either
a first CDR-H1 comprising the amino acid sequence of NYGII (SEQ ID NO: 813),
a first CDR-H2 comprising the amino acid sequence of WINTYTGKPTYAQKFQG (SEQ ID NO: 814), and
a first CDR-H3 comprising the amino acid sequence of KLFTTMDVTDNAMDY (SEQ ID NO: 815); or
a second CDR-H1 comprising the amino acid sequence of DYEIH (SEQ ID NO: 819),
a second CDR-H2 comprising the amino acid sequence of VNDPESGGTFYNQKFDG (SEQ ID NO: 820), and
a second CDR-H3 comprising the amino acid sequence of YSKWDSFDGMDY (SEQ ID NO: 821); and
wherein each of the VD1 and VD2 of the second polypeptide chain is a light chain variable domain that binds TNF-α and IL-17 and comprises either
a first CDR-L1 comprising the amino acid sequence of RASQDISQYLN (SEQ ID NO: 816),
a first CDR-L2 comprising the amino acid sequence of YTSRLQS (SEQ ID NO: 817), and
a first CDR-L3 comprising the amino acid sequence of QQGNTWPPT (SEQ ID NO: 818); or
a second CDR-L1 comprising the amino acid sequence of RASSGIISYID (SEQ ID NO: 822),
a second CDR-L2 comprising the amino acid sequence of ATFDLAS (SEQ ID NO: 823), and
a second CDR-L3 comprising the amino acid sequence of RQVGSYPET (SEQ ID NO:824);
wherein both VD1s bind one target protein and both VD2s bind the other target protein.

4. The binding protein of claim 3, wherein the VD1 or VD2 of the first polypeptide chain comprises the amino acid sequence of SEQ ID NO: 661, and the VD1 or VD2 of the second polypeptide chain comprises the amino acid sequence of SEQ ID NO: 666.

5. The binding protein of claim 3, wherein the binding protein comprises two first polypeptide chains and two second polypeptide chains.

6. The binding protein of claim 3, wherein the VD1 of the first polypeptide chain comprises the first CDR-H1 that comprises the amino acid sequence of NYGII (SEQ ID NO: 813), the first CDR-H2 that comprises the amino acid sequence of WINTYTGKPTYAQKFQG (SEQ ID NO: 814), and the first CDR-H3 that comprises the amino acid sequence of KLFTTMDVTDNAMDY (SEQ ID NO: 815);
wherein the VD2 of the first polypeptide chain comprises the second CDR-H1 that comprises the amino acid sequence of DYEIH (SEQ ID NO: 819), the second CDR-H2 that comprises the amino acid sequence of VNDPESGGTFYNQKFDG (SEQ ID NO: 820), and the second CDR-H3 that comprises the amino acid sequence of YSKWDSFDGMDY (SEQ ID NO: 821);
wherein the VD1 of the second polypeptide chain comprises the first CDR-L1 that comprises the amino acid sequence of RASQDISQYLN (SEQ ID NO: 816), the first CDR-L2 that comprises the amino acid sequence of YTSRLQS (SEQ ID NO: 817), and the first CDR-L3 that comprises the amino acid sequence of QQGNTWPPT (SEQ ID NO: 818); and
wherein the VD2 of the second polypeptide chain comprises the second CDR-L1 that comprises the amino acid sequence of RASSGIISYID (SEQ ID NO: 822), the second CDR-L2 that comprises the amino acid sequence of ATFDLAS (SEQ ID NO: 823), and the second CDR-L3 that comprises the amino acid sequence of RQVGSYPET (SEQ ID NO: 824).

7. The binding protein of claim 3, wherein the VD2 of the first polypeptide chain comprises the second CDR-H1 that comprises the amino acid sequence of DYEIH (SEQ ID NO: 819), the second CDR-H2 that comprises the amino acid sequence of VNDPESGGTFYNQKFDG (SEQ ID NO: 820), and the second CDR-H3 that comprises the amino acid sequence of YSKWDSFDGMDY (SEQ ID NO: 821); and
wherein the VD2 of the second polypeptide chain the second CDR-L1 that comprises the amino acid sequence of RASSGIISYID (SEQ ID NO: 822), the second CDR-L2 that comprises the amino acid sequence of ATFDLAS (SEQ ID NO: 823), and the second CDR-L3 that comprises the amino acid sequence of RQVGSYPET (SEQ ID NO: 824).

8. The binding protein of claim 3, wherein the VD1 of the first polypeptide chain comprises the first CDR-H1 that comprises the amino acid sequence of NYGII (SEQ ID NO: 813), the first CDR-H2 that comprises the amino acid sequence of WINTYTGKPTYAQKFQG (SEQ ID NO: 814), and the first CDR-H3 that comprises the amino acid sequence of KLFTTMDVTDNAMDY (SEQ ID NO: 815); and
wherein the VD1 of the second polypeptide chain comprises the first CDR-L1 that comprises the amino acid sequence of RASQDISQYLN (SEQ ID NO: 816), the first CDR-L2 that comprises the amino acid sequence of YTSRLQS (SEQ ID NO: 817), and the first CDR-L3 that comprises the amino acid sequence of QQGNTWPPT (SEQ ID NO: 818).

9. The binding protein of claim 3,
wherein the VD1 heavy chain variable domain comprises the amino acid sequence of SEQ ID NO: 661, the X1 in the heavy chain domain comprises the amino acid sequence of SEQ ID NO: 662, the VD2 heavy chain variable domain comprises the amino acid sequence of SEQ ID NO: 663, and the heavy chain constant domain comprises a CH domain of SEQ ID NO: 664; and
wherein the VD1 light chain variable domain comprises the amino acid sequence of SEQ ID NO: 666, the X1 in the light chain domain comprises the amino acid sequence of SEQ ID NO: 667, the VD2 light chain variable domain comprises the amino acid sequence of SEQ ID NO: 668, and the light chain constant domain comprises a CL of SEQ ID NO: 669.

10. The binding protein of claim 3, wherein the VD1 of the first polypeptide chain comprises the amino acid sequence of SEQ ID NO: 661, the VD2 of the first polypeptide chain comprises the amino acid sequence of SEQ ID NO: 663, the VD1 of the second polypeptide chain comprises the amino acid sequence of SEQ ID NO: 666, and the VD2 of the second polypeptide chain comprises the amino acid sequence of SEQ ID NO: 668.

11. A binding protein that specifically binds TNF-α and IL-17, and comprises four polypeptide chains,
wherein two first polypeptide chains comprise VD1-(X1)n-VD2-C-(X2)n, wherein
VD1 is a first antibody heavy chain variable domain;
VD2 is a second antibody heavy chain variable domain;
C is a heavy chain constant domain;
X1 is a first linker with the proviso that it is not CH1;

X2 is an Fc region; and
n is 0 or 1;
wherein two second polypeptide chains comprise VD1-(X1)n-VD2-C-(X2)n, wherein
VD1 is a first light chain variable domain;
VD2 is a second light chain variable domain;
C is a light chain constant domain;
X is a second linker with the proviso that it is not a light chain constant domain;
X2 does not comprise an Fc region; and
n is0 or 1;
wherein each of the VD1 and VD2 of the two first polypeptide chains is a heavy chain variable domain that binds TNF-α or IL-17 and comprises either
a first CDR-H1 comprising the amino acid sequence of NYGII (SEQ ID NO: 813),
a first CDR-H2 comprising the amino acid sequence of WINTYTGKPTYAQKFQG (SEQ ID NO: 814), and
a first CDR-H3 comprising the amino acid sequence of KLFTTMDVTDNAMDY (SEQ ID NO: 815); or
a second CDR-H1 comprising the amino acid sequence of DYEIH (SEQ ID NO: 819),
a second CDR-H2 corprising the amino acid sequence of VNDPESGGTFYNQKFDG (SEQ ID NO: 820), and
a second CDR-H3 comprising the amino acid sequence of YSKWDSFDGMDY (SEQ ID NO: 821);
wherein each of the VD1 and VD2 of the two second polypeptide chains is a light chain variable domain that binds TNF-α or IL-17 and comprises either
a first CDR-L1 comprising the amino acid sequence of RASQDISQYLN (SEQ ID NO: 816),
a first CDR-L2 comprising the amino acid sequence of YTSRLQS (SEQ ID NO: 817), and
a first CDR-L3 comprising the amino acid sequence of QQGNTWPPT (SEQ ID NO: 818); or
a second CDR-L1 comprising the amino acid sequence of RASSGIISYID (SEQ ID NO: 822),
a second CDR-L2 comprising the amino acid sequence of ATFDLAS (SEQ ID NO: 823), and
a second CDR-L3 comprising the amino acid sequence of RQVGSYPET (SEQ ID NO: 824);
wherein all four VD1s blind one target protein and all four VD2s bind the other target protein.

12. The binding protein of claim 11, wherein the VD1 of the two first polypeptide chains comprises the first CDR-H1 that comprises the amino acid sequence of NYGII (SEQ ID NO: 813), the first CDR-H2 that comprises the amino acid sequence of WINTYTGKIYIYAOKFQG (SEQ ID NO: 814), and the first CDR-H3 that comprises the amino acid sequence of KLFTTMDVTDNAMDY (SEQ ID NO: 815);
wherein the VD2 of the two first polypeptide chains comprises the second CDR-H1 that comprises the amino acid sequence of DYEIH (SEQ ID NO: 819), the second CDR-H2 that comprises the amino acid sequence of NVDPESGGTFYNQKFDG(SEQ ID NO: 820), and the second CDR-H3 that comprises the amino acid sequence of YSKWDSEDGMDY (SEQ ID NO: 821);
wherein the VD1 of the two second polypeptide chains comprises the first CDR-L1 that comprises the amino acid sequence of RASQDISQYLN (SEQ ID NO: 816), the first CDR-L2 that comprises the amino acid sequence of YTSRLQS (SEQ ID NO: 817), and the first CDR-L3 that comprises the amino acid sequence of QQGNTWPPT (SEQ ID NO: 818); and
wherein the VD2 of the two second polypeptide chain comprises the second CDR-L1 that comprises the amino acid sequence of RASSGIISYID (SEQ ID NO: 822), the second CDR-L2 that comprises the amino acid sequence of ATFDLAS (SEQ ID NO: 823), and the second CDR-L3 that comprises the amino acid sequence of RQVGSYPET (SEQ ID NO: 824).

13. The binding protein of claim 11, wherein the VD1 or VD2 of the two first polypeptide chains comprises the amino acid sequence of SEQ ID NO: 661 or SEQ ID NO: 663, and the VD1 or VD2 of the two second polypeptide chains comprises the amino acid sequence of SEQ ID NO: 666 or SEQ ID NO: 668.

14. The binding protein of claim 13, wherein the VD1 of the two first polypeptide chains comprises the amino acid sequence of SEQ ID NO: 661, and the VD1 of the two second polypeptide chains comprises the amino acid sequence of SEQ ID NO: 666.

15. The binding protein of claim 13, Wherein the VD2 of the two first polypeptide chains comprises the amino acid sequence of SEQ ID NO: 661, and the VD2 of the two second polypeptide chains comprises the amino acid sequence of SEQ ID NO: 666.

16. The binding protein of claim 13, wherein the VD1 of the two first polypeptide chains comprises the amino acid sequence of SEQ ID NO: 663, and the VD1 of the two second polypeptide chains comprises the amino acid sequence selected of SEQ ID NO: 668.

17. The binding protein of claim 13, wherein the VD2 of the two first polypeptide chains comprises the amino acid sequence of SEQ ID NO: 663, and the VD2 of the two second polypeptide chains comprises the amino acid sequence selected of SEQ ID NO: 668.

18. The binding protein of claim 13, wherein the VD2 of the two first polypeptide chains comprises the amino acid sequence of SEQ ID NO: 663, and the VD2 of the two second polypeptide chains comprises the amino acid sequence of SEQ ID NO: 668, and wherein the VD1 of the two first polypeptide chains comprises the amino acid sequence of SEQ ID NO: 661, and the VD1 of the two second polypeptide chains comprises the amino acid sequence of SEQ ID NO: 666.

19. The binding protein of claim 13, wherein the two first polypeptide chains comprise the amino acid sequence of SEQ ID NO: 660.

20. The binding protein of claim 13, wherein the two second polypeptide chains comprise the amino acid sequence of SEQ ID NO: 665.

21. The binding protein of claim 11,
wherein the VD1 heavy chain variable domain comprises the amino acid sequence of SEQ ID NO: 661, the X1 in the heavy chain domain comprises the amino acid sequence of SEQ ID NO: 662, the VD2 heavy chain variable domain comprises the amino acid sequence of SEQ ID NO: 663,and the heavy chain constant domain comprises a CH domain of SEQ ID NO: 664; and
wherein the VD1 light chain variable domain comprises the amino acid sequence of SEQ ID NO: 666, the X1 in the light chain domain comprises the amino acid sequence of SEQ ID NO: 667,the VD2 light chain variable domain comprises the amino acid sequence of SEQ ID NO: 668, and the light chain constant domain comprises a CL of SEQ ID NO: 669.

22. The binding protein of claim 11, wherein the X1 in the two first polypeptide chains and the two second polypeptide chains independently comprises an amino acid sequence selected from the group consisting of SEQ ID NOs: 1-29, 662, and 667.

23. The binding protein of claim 11, wherein the Fc region comprises a variant Fc region.

24. The binding protein of claim 1, 3, or 4, wherein the X1 comprises the amino acid sequence of any one of SEQ ID NOs 1-29, 662, and 667.

25. The binding protein of claim 2, 4, or 13, wherein VD1 of the first polypeptide chain(s) comprises the amino acid sequence of SEQ ID NO: 661.

26. The binding protein of claim 2, 4, or 13, wherein VD2 of the first polypeptide chain(s) comprises the amino acid sequence of SEQ ID NO: 661.

27. The binding protein of claim 2, 4, or 13, wherein VD1 of the second polypeptide chain(s) comprises the amino acid sequence of SEQ ID NO: 666.

28. The binding protein of claim 2, 4, or 13, wherein VD2 of the second polypeptide chain(s) comprises the amino acid sequence of SEQ ID NO: 666.

29. The binding protein of claim 1, 3, or 11, wherein the binding protein comprises an amino acid sequence selected from the group consisting of SEQ ID NOs: 554, 559, 734, 774, and 779.

30. The binding protein of any one of claim 1, 3, or 11, wherein the binding protein neutralizes both human TNF-α and human IL-17.

31. A pharmaceutical composition comprising the binding protein of any one of claim 1, 3, or 11, and a pharmaceutically acceptable carrier.

32. The pharmaceutical composition of claim 31, further comprising at least one additional therapeutic agent.

33. The pharmaceutical composition of claim 32, wherein the additional therapeutic agent is a cytotoxic agent, an angiogenesis inhibitor, a kinase inhibitor, a co-stimulation molecule blocker, an adhesion molecule blocker, an anti-cytokine antibody or functional fragment thereof, methotrexate, cyclosporin, rapamycin, FK506, a TNF antagonist, an antirheumatic, a muscle relaxant, a narcotic, a non-steroid anti-inflammatory drug (NSAID), an analgesic, an anesthetic, a sedative, a local anesthetic, a neuromuscular blocker, an antimicrobial, an antipsoriatic, a corticosteriod, an anabolic steroid, an erythropoietin, an immunization, an immunoglobulin, an immunosuppressive, a growth hormone, a hormone replacement drug, a radiopharmaceutical, an antidepressant, an antipsychotic, a stimulant, an asthma medication, a beta agonist, an inhaled steroid, an epinephrine or analog, a cytokine, or a cytokine antagonist.

34. A binding protein that specifically binds TNF-α and IL-17 comprising two first polypeptide chains each comprising the amino acid sequence of SEQ ID NO: 660, and two second polypeptide chains each comprising the amino acid sequence of SEQ ID NO: 665.

35. The binding protein of claim 34, wherein the two first polypeptide chains comprise the amino acid sequence of SEQ ID NO: 774, and wherein the two second polypeptide chains comprise the amino acid sequence of SEQ ID NO: 669.

* * * * *